United States Patent 10,233,495 (METHODS AND COMPOSITIONS FOR SCREENING AND TREATING DEVELOPMENTAL DISORDERS) - sequence listing, part 111

SEQ ID NO: 621 - DNA, 117792996 bp, Homo sapiens (residues 80,772,385-82,455,142 of 117,792,996)
  misc_feature (358797)..(383796): n is a, c, g, or t
  misc_feature (12480561)..(12530560): n is a, c, g, or t
  misc_feature (13211533)..(13391532): n is a, c, g, or t
  misc_feature (15763259)..(15813258): n is a, c, g, or t
  misc_feature (21949357)..(24949356): n is a, c, g, or t
  misc_feature (39920968)..(39940967): n is a, c, g, or t
  misc_feature (76754544)..(76824543): n is a, c, g, or t
  misc_feature (78946938)..(78966937): n is a, c, g, or t
  misc_feature (106685630)..(106715629): n is a, c, g, or t
  misc_feature (112143340)..(112183339): n is a, c, g, or t
ttagtttacctcgtatttgggaatacctactaggaaaactcagcctaattttattacatgcacctacccaaactgaaagagaagggacaagggaccatcttaagctaccaaagcattctattttgtgaggaaatatctctttactctttattggtaaaatgtgtttttaagaacagctctctaaagcagccttctcaaagcagttctcacccccagactctctaaattggattatctggggatggagctgaagtacctacactttaaacactcccctctccacactacctctgccaatcaatttttattcaccattgaaaaccaaagctctagaatatatgaatattgtaaattgggggaaagggtgtatgtttcctttgccatattgacttgaatatgtttattccatagaataagggatttggaactcaaacacctattatttatgtttaaaaaagttatttcaaagtagtgtactttatcagtcacagctgatacatttgtctgcaaattattggacttttacagttaactgagttgatacttttttcatttttgttaaggactcaactaaagaagtttcttggaaaatcagtaaagagagcaaagcaccttgctgaggaatatggtgaacgtgctataaataaagttaaaagtgttagagatgaaggtgagttaaaacagaacatttcaactaaacattcaattaatttgtaatcgtctaaatttagcctgtagtttgtaagaagcattctatttaaaatagtaaacctttatagctgacatcttagtatttcaataaataaggtactctatgacttaattttatgagtgtgaagaaaaatggatttatacatattttgtgacttttgacagtctgaaatggttgagtgttaaataatcagttatgaattagtttcgtttgtttgtttgtttgtttatttgagatggagtcttactctgttgcccaggctggagtgcagtggcgcgatctcggctcactgcaagctccacctcccaggttcacaccattctcctgcctcagcctcccgagtagctgggactacaggcgcctgccac[184 bp omitted]cttttttctttttttttgagaaagtcttgctctgtcgcccagactggggtggaatggcatgatcttggctcactgcaacctccgtctcctgggttcaagccattctcctgcctcagcttaccaagtagctgggattataggcacacaccaccacacctggctaatttttgtatttttagcagagacagggttttgccatgttggccaggctggtattgaactcctgacctcaggtgatccacccacttctacctcccaaaatgctggaattacaggcatgagccaccacgtctggccaaggctatttttttcttttttggagatggagtctcgctctgtcacccaggctggagtacagtggcacgatctcggctcacttcaacctctgcctcctgggttcaaacaattctcctgcctcagcctcccaagtagctgggattacaggcacctgccaccacacctggctaatttttgtatttttagtagggacagggtttcaccatgttgcccaagctggtctcgcactgatgacctcaggtgatctgcccacctcagcctctcaaagctctgggattacaagcgtgagccaccgcgcctggccagctatttggtttttacaaatacagtcagtcctccatatccatgggttccacatggagggattcaaacaaccacagatagaaaaatatttttaaaaatatataaaaaataacaatgcaacaataaaacataatagaaaaaataatataacaactatttatataacatttacactgcagtagatattataagtaatctagagattatttaaagtatacagggcgaggcatggtggctcatgcctataattccagtactttgagaggccaagacaggagaaccgcttgaggccaggagttcgagactagcctggtcaaacatagtgagaccctgtctctactaaaaaataaaaattagctttgtgtagtgacgtgtgcctatagtcccagctactcagaaggccaaggagcaggattgcttgagcccaagagttcagggctgcaatgagctatgattgcaccattgcactccaacctgagaccctgtctttaaaaaagaaagcaagtacgtgaaaggatgtgcataggttatatgcaaataccatgccattttatgttaagggatttgagcattcgcagattttggtacccatagcaggtcctgccatggatactggggaataactgtattttcaaaattaggtagggctgggtatgatggctcatatctgtaatcccaacactttggaaggctaaggcaggaggatcacttaagcccaggagttggagaccagcttgggcaacatagtgagacccctgtttgtataaaaataaataaataaatttttttaattaggtaaattttctaaatttgcacatatcttaacctcctatgcttttgtcattattgtactcatttgttttatttaatgaaacttacatagtacttattcagtgcctgggactgtactaagcacttttacctgtattaattcatttaatcccatagaaaccctatgaggtaagtaccatcattatccccatttgatagatgagaaaactaagaggcatcgaaagttgagtaacttgcctgtggtcacacagataataaatgacagagctggatttgaacctggcagtctggcattagactccatgtttttaaccagtatgttatataataaataaattttgctcttccatttaatgaattttcttggtatgcaggaaatatgaaattatgataatagcaatatctacattagctagtagtgatttctgttgcttttctgttcagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatggtaagcaactttttcattttttaggattgatactgtttttgttaagagaaatactttggcttctacaaaactatctctttctatgtatgtaactttgctagcctgactcaagaacggggaatttatgttaacatgattta[150 bp omitted]atggcgaaaccctgtctctacgaaaaatataaaaattagccaagcatggtggcgggtgcctgtaatcccagctacttgggaggctgaggcaggagaattgcttgaacccaggaggcagaggttgtggtgagtcgagtttgtgccactgcactccagcctgggctacagagtaaaaaactccgtctcaaaaaaaaaaaaaaaagaaagaaaggagttattgaataagtaaactctcaggctgtatcactaagaaagctatgcaaaggcaccaaactttaaagcagttagattagagggtgtaactttgaaaaatgtttaaaatgctcccaaccatattttaaataatttacaaaatatatcagaagctcaatatatgttgtaaagtgagatattcagctaaaacaaggagagaggtaaaagttcaagttctcctttagagttcaaatgtaccaatgtagatgcaattgcacaaactgtattgtggttaacccctgaaaatgctaggaacacaaagaaggcagtgataaaatttagatctgaataaataatactgtgcccttgatcagggaatctgtttacattttaagtctaaaagttggcttaactagaatgaagcaaccataaatatattggatggcaaccaaattcaaatttaaattttgatgtttacagataaatgtttgagttgattttagtattttccttaaggaaattgatgaatttcctagtactgtattgactcgttatttcctgttttaaataaaatctcatcgtagtaggctccaaatgactcatttttaatacacttgaattttgtagaagtgaatggttatttcaataaatgggctgtggcataatctttttgatacatctgaatgtgtatataatagtatttcttgtaataagatttggtctttccaacttaagaggttcatgttctttctccctgctcctccacccccaccacacacacatactttcctattgttctcagtatctagagattctggtcatatactttgaaaccttgtttctagagagaaaagtaggatgagaccacaccactccaatacaactacctttttttttttttctttttgtggcagagtctcgctctgtcacccaggctggagtgcaggggcgggatctcagctcactgaagcctctgcctcctgggctcaagcagtcctccctcctcagcctcctgagtagctgggaccacaggtgcgcaccaccatgcctggctaattttttgtattttttgtagagatggggtttcgccatgttgcccaggctagtctcaaactcctgagctcaagtgatccacccgcctggacctcccaaagtgctgggattacaggcgcgtgccaccacgcccggcccattccaaaactgtaatacttctaagtgctggatgctatacgggtcactgccaaggtgggctttagtcttcctcagtcctgctcagttgttagtgctatgctgagggctctgccacccatctttacgttcagctaggggactaagatccccagctaggatttgtgcttttccaatgaagatttctgaccactttagaactcccatttctgttaatatgtggacagggtttgagttcttgaagttgttagtttagattatggaacactacaactatcttaccctacctttcttgtgaaagtctacttttgtggtattatagcaccattgaacttttggacttaagtagtgttagcaatttgagcattatcttagtatatgtaatttggcgtaattttaaactttggctttaaagtaatgtctctattttattttatttattattatttttagatagagtttcgcttttgttgcccaggctggagtgcaatggcgcggtcttgactcactgcacccttcacctcccaggttcaagtgatcctcctgcctcagcctcctaagtggctgggattacaggcgcccgccaccatgcccagctaatttttgtatttttagcagagatggggttttaccatgttggccaggctggtctcgaactcctgaccttaggtgatccacctgcctcagcctcccaaagtgctgagattacagacgtgagccaccatgccaggccaaaagtaaagtctctaaaggtgtaaagtattaactttgaaacttcttttgttttcatagggagctgtttggaccatgaaattttctcactgtggccgattacttgcctcagctggacaagacaatgtagtgagaatatgggctttaaaaaatgcttttgactatttcaacaatatgcgaatgaaatacaatactgaaggtatttttcatctatttaaaaatctacagaaacctgaagtttttacattttaggtatactgatgccctacttttctggcagtcatttgcagcaaccactacttatgataatagccaaaaacttgaaagtaagacagacgtcagtggcaaaaagtctctaaacccaatgaaaagagctgccacaaagcttttgatttattcctttccaggtgtagtgtgtagttaatttcatcaactattgagaacatgatatttggtttcctctggcaaccttcagttctatcctaggttaaaatagaattgctaattaaactggaaaaagaatgaaaatcatatatatccagtaagtaaaaatgattaaggaaaaagtcatggaaaatgaatgtgaattgtcaatatatcaagggatatatgaaaaaatgttgaaaagagaagcctcagaacattatgtacacactgattacaactatgtacagatatttatgtatcatggtgttatcaggaaagtatgtagaactgatgtaaatttgggctttaagttcatgggattcttttctaataactatttaactgtgtaataagttttttccacaccctccccgccatcaagtaaggctgcaaacgagaagtaaagcataggagaaaggagaagaaaggtggccatgggtgagagtatatagtcaaagcaccaatttgaggaacataaaagtctagggagattcactaaactggcaagctagacctcatatacttgagtaaatcctgtgagtattgcttgcattatgtttcagtacttagttgaagatgataataatttgacaagaagttaaactgtgtttactatatggtgagtttttctagtcctagctgtgtgtcatttcttttactgccctgccaagagcaaaaagactattttcagtggcccttgagactaaccccagccctgaacctttctgctcctttattgttcctcttgctacttgtcatgattaataagaatgtgttctattcgaatactgaggatttaacggtattttgtttactaaagtagggaaatggttaagccattttatgaagtttttatgtaaaaatgattgaaacaaatattttggctcctatagggttatgcctcaattgttagtatttttctagaatactgtattctctaactattagacattgctgtgtcattacttctggatgttatattttggtgggtctgtgtgtgtacatacatgccttttttacaattattatgttgtttttaggacgtgtgtccccatcaccctctcaggaaagtctaagttcatcaaaatcggatacagatacaggggtatgcttattgttttatggttactctgttttcaggtatgatttaatttgtttaccataaagtatttttgtgtatcagaaattacagttgcatgaagacacttaatataaaattaagatgtatcattagaaccaagagtttcttcaattagaagaaattagcaaatgaaaatttttgatatttaaaggttgccagacagtgaatactattgctcagggtactataccactaatgtaaacttaaataatacaaaagcccctcccctcaaatccatgttagacatttttaaaataatgataatagatacccaaataagaggtaattaaggaaagaaaaaatatatttaagtattttaattttctaatcttcttggtttaataaacactttatcacagtttcagataaggtatcttaatgattttcatttggttttagagctggaaggttaaatataaccaattttaaacctataaagcagaatacacaatattgtactaagttgtcacctgtgttttttgtgtgttgcattaggtaagggtgatataaacaagagaacctaaaatgtctacctgctcaacagtattttcctgagatttcattggctccagtatttgacactacgttttctccttctcctggctttccatggttctgtttccctttgttctcttatactcccactgtttcttcttccatctccttacatttactgtttctcagggtctgttcttggccattttcaatagacatatttatgctcttcttctagtcctgaactggctttagatctgtaattctttgtttactttcagtaactttatgatttttaaacaagaacattattgtgcttgctgccttttcacataatatataggatctctttatctacatgtaatccaaccacatcaactaataggtccaaaactaaactccttcaacaaatgttttctgagtgcctgctatatgtggcagacactgctacatgctataaaatcaaatgagacatattctctgtcctcagggatcttgtgaactagtgaaatgggtaaactcacaattacagtattagatggtgatattctacagaaggtactacacaaaaataggttagccttataaatcacagtgttaggaatagtttcctggaaacttgttatttgagctaggatttagctatatgagagaagaaaggaaggagcgtgtcagacccagggactagcaagtgcaaaagcatggaggctagtatgttaaaggtactacaaggaattacacatggctgggaaaggtgcatttgtgagattggtgggagaggtaggcaggagtggaattttaaatgactttttgtgatgaaccaagatggaactttatcctgcaaactactgggagcagggtggggctttgaaggatttcactcagaggcataattaccatgttcagatttttgttttagaaagagtattctggtagtattgtgaaggatagactaggtgggggcttcaggtttgagacagggagaccatgtaagaggctattaacccagagaaatggttacttccgattttgatgattatgataccagtagagctagaaactgtaaagataagctgaattgagagatgtaaaataagtctaatttgtaggacttggtgactgactagctggggtagtaaaagtgagtagcctgggatgaatcacaggtgtctagcttgcgtagttagctacatggtaatggtcactcatagaaatattttttatattttaatttttccataagttattggggtacaggtggtatttggttacataagttctttagtgattttggtgcacccatcacccaaggagtatacactgcacctatttgtagtcttttattcctcaccctcctcccactcttcctcccaagtccccaaagtccattgtatcattcttacatctttgcgtcctcatagtttagctcccacatatcagtgagaacatacaatgtttggttttccattcctgagttacttctcttagaataatagtctccaatctcatccaggttgctgcaaatgctgttaattcattcctttttatggctgagtagtattccatcgtgtatacataccagtttctttatccactcgttgattgatgggcatttgggttggttccacgtttttgcaattccaaattgtgctgctataaacgtgcgtgtgcaagtatctttttctaataatgacttcttttcctctgggtagatacccaatagtgggattgatggatcaaatgttagttctacttttatttctttaaggaatctccacgctgttttccacagtggttgtattagtttacattcccactagcagtgtagaagtgttccctgatcaccacatccacgccaacatctattttttgattttttattatggccattcttgcaggagtaagatggtatcacatcgaggttttgatttacatttccctgattattgtgatgttgagcattttttcatacgtgtgttggccatttgtatatttttttgagaattgtctatttatgtccttagcccactttttgatggactgtttttttcttactgatttgtttgagtttgttgttcattctggatattagttagtccttagttggatgtatagattgtgaagattttctcccactctgtgggttgtctgtttactctgctgactgttccttttgctgtgcaaaagctcgttagtgtaattaagtcccaactatttatttttattgcatttgcttttgggttcctggtcatgaaatccttgcctaagccaatgtctagaagggtttttccaatgttatcttctagaatttttatgctttcaggtcttagattcgagtccttaatccctcttgagttgatttttgtataaagtgagagatgaggatccagtttcattatcctacacgtggctagccagttatctcagcaccatttgttgaaaagggtgtcctttccccactttttatgtttttgtttgctttgtcaaagatcagttggctgtaaatatttgggtttatttctgggttctctattgttttccattggtctgtgtgcctatgtttataccagtaccatactgtcttggtgactatggccttatagtttgaaatcagtaagtgtgacgcctccgtatttgttcttttgcttagtcttgctttggctgtgtgggctcttttggttccatatgaattttagaattgttttttctaattctgtgaagaatgatggtggtattttgatggggattgcgttgaacttgcgattgctttttttttttttttttttatgttccatggttttgtgtttttttttttccattactggatatatacccaaaggactataaatcatgctgctataaagacacatgcacacgtatgtttattgtggcactattcacaatagcaaagtcttggaaccaacccaaatgtccaacaataatagactggattaagaaaatgtggcagattgctttttgaagtatggccattttcacaatattgattctacccatccatgagcatgggatgtgtttccatttgtttgtgtcgtccatgatttctttcagcagcgttttgtagttttccttgtagatgtctttcgcctctttggttaggtatattcctaagtattttatttttttgcagcttttgtaaaagtgattgagttatcgatttgattcttcgcttggttgctgttggtgtatacaagagctactgatttgtttacattaatcttgtatctggaaactgtgctgaattcttttatcagttctgagctttctggaggagtctttagggtttccgaggtaaatgatcatatcgtcagcaaacagtgacagtttgactttctctttaccccatttgaatgccctttatttctttctcttgtctgattgctctggctaggacttccagtactgtgttgaagaggagtggtaagagtgggcatccttgtcttgttccagttctcagagggaatgctttcaatttttccccattcagtattatgttggctgtgggtttgtcatagatggcttttattacactgagatatgtcacctgtatgctgattttgctgagagttttaatcataaaggatgctggattttgtcaaatgctttttctgcatctattgagatgatcatgtgatttttgtttttaattctgtttatgtggtgtatcacatttattgacttgcatatgttaaaccatccctgcatccctgctatgaaacccacttgaactgggtggattatcttttcgatatgttgttggatttggttagctagtatgttgttaaggattttagcatctatgttcatcagggatattggtctgtagttttcttttttggttgtgtcctttcctgattttggtattagtgggtgatgctggcttcatagaatgaattagggaggattccctctttttctatcttgtggaatagtgtcaaaagaattgttaccaattcttctttgaatgtctggtagaattctgctgtgaatccatctggtcctggactttttttgagatggagtctcactctgttgcccaggctggagtgcagtggcgcaatctcagctcactgcagcctccgcctcctgggttccaacgattctcctgcctcagccttcctggtagctgggattacaggcacacaccaccatgcccggctagtttttgtatttttagtagagacgaggtttc[133 bp omitted]tttaaattaccatttcaatctcgctgcttgttattggtctgttcagggtatctatttcttcctaatttaagctaggagggttgtatttttccaggaatttttccatctcttctaggttttctagtttatgtgcataaaggtgttcatagtagccttgaatgatcttttgtatttcagtgatgtcagttgtaatatctcctgtttctcttcttaatgaggttatttggattttctcttttattttcttggttaatcttgctaacagtctatcaattttatttatcttttcaaagaaccagctttgtgtttcatttatcttttgtattttttgtttgtttcaatttagtttaattctgctctgatcttggtaatttcctttcttctgctggctttgggtttggtttgttcttgtttctctagttccttgaagtgtgaccttagcatgtcagtttgtgctctttgagtctttttgatgtaggcatttatagggctatgaactttcctgttagcaccacctttgctgtatcccaaaggttatgatagattgtttcattattgtcattcagttcaaataattttttaatttccatcttgatttcatttttgaccgagtgctcattcaggagcaggttattttatttccatgtatttgcacggtttcgaaggttccttttggagttcatttccagttttattccactgtagtctgagagagtgcttgatataatttcaattttcttaaatttattgaggctcgttttatggcctatcatatggtctatcttggagaaggttccatgcgctattgaatagaatgtgtattctgcagttgttggatggaatgttctgtatatatatctgttaagtccatttgttccaaggtatagtttaaattcgttgtttctttgttgactttctgccttgatgacctgtctagtgctgtcagtggagtattgaagtccccaactattatcgtgttgccgtctatctcatttcttaggtctattagtaattgttttataaatttgggagctccagtcttaggtgcataaatgtttaggattgtgatattttcctgttggacaaggccttttactgttatatcatgtccctctttgtctcttttaaatgctgttgctttaaagtttgttttgtctgatataagaatagctacccctgttcgcttttggtgtccatttgcatgaaacgccttttaccacccctttaagtttatttgagtccttatgtctcctgaagacagcagatagttggttggtgggttcttatccattctgcatctctgtatcttttaactggagcatttaggccacttacattcaatgttagtattgagatgtgagatacctcatagtgttatttgttgcctgtgtaccttggttttttttgtttttgctttttaacttacatttttgttttataggttctgtatgatttatgctttaaagaagttctgttttaatgtgtttccaggatttgtttcaagatttagagctcgttttagcagttcttatagtggtggcttagtagtggcaaattctctcagcatttgtttgtctgaaaacgactgtatctttccttcatatatgatacttagttttactggatacaaaattcttagtgataattgttttgtttgaggaggctgaagatagggccccaatcccttctagcttgtagggtttctgctgagaaatccgctgctaatctgttaggttttcctttatacgttacctggtgcttttgtctcacagctcttaagattctttcctttgtcttaactttagataacgtgatgacagtgtgcctacgcgatgatcattttgtgatgaatttcccacttgttctttgtgcttcttgtatttgaatgtctagatctcgagcaaggccggggaagttttccttgattattcccccaaatatgtttttcaaactttcagacatctcttcttcctcaggaacatcagttattcttaggtttggtgtttaacataatcccagacctcgtagaggcttcattcatattctcttattcttttttctttgtctttgttgtattgggttaatttgaagaccttgtctttgagctctgaatttctttcttctacttgttcaattctattgctgagactttccagagcatttttcatttctataagtgtgtacagtgtttcctgaagtttttattgttttttttctttatgctatccatttccttgaatatttctcccttcacttcttgtatcgttttttggatttcactgcattgggctttgcctttctctggcgcctcccagattaacttaataactaacctcctgaattctttttcaggtaaatcagggatttcttattggtttggatgcattgctgatgaactagtgtgatttttcgggggttgttaaagagccttgttttgtcaaattaccagagttggttttctggttccttctcatttgggtaggctctgtcagagtctagggctgaaggctgttgttcagattcgtttgtcccactgggtgttcccttgatgtagtactcttccctttttcctatggatgtggcttcctgtgagccgagctgcagggattgttatctctcttctgggtctagccacccagcaagtctacccagctctgagctggtactggaggttgtctgcagagagtcctgtgatgtgaaccgtctatgggtctctcagccgtggataccagcacctgtaccagtggaagtggcaggggggtgaaatggactctgtgagggttcttagctttggtggtttaattttctatttttgtgctggttggccttctgctgggaggtggcgctttccaaagagcatcaagctatggtagtatggattggaaatggtggtgggtggggccctagaactctcaagagtatatgccctttgtcttcagctaccagggtggataaggaaggcccatcaggtgggggcagggctaggtgtgtctgagctcagaatctccttggttgggtcttgctgaggctgctgtgggggatggatgtgatgttcccaggtcaatgaagttgcgtacctaggaagattatggctgcctctgctgagtcatgcaggttgtcagggaagcgggggaaagctggcagtcacaggcctcacccagctcccacacaaacggaagggccagtctcactcccaccatgccccctcaacagccccaagtctgtttccaggcagtaggggatctgggcctgagaacttgccccaggctactcacctcccagctgtgaaagaaaaaggcttggttctttccccacctatggagtctgcacaccggattcgtgccctcccccttctggccaggaggcttctcgccagttcaaattgttacaaagttcagctggagacttccttctccctatagtgtttcccctcctattcctctggctgccctcccgaaggatccctgtggtgccaggcaggaatggcctgcttgaagacccagcgagctcccaaggctttcctgctgcttcctctacttctatatttcgctgggctctctaaattgactcagctccaggtaaggtcagaaacttatcctgcaaacagacgttcagtttccccagtgggggtgtgtgttccggagaggaggatctccctttcccacttctgcagtttgggcactcacagtattcggggtgtctcctgggtcctgcaggagcattctgcttccttcagagggtctgtgggttctcttgggattcctagttctttcttgcagtcgatctgcagctaaaattcatggtgtgagcctccgcatgctgctctgtccatctgagtaggagctgcaatctagtcctgcctcctgtctgccatgatggcatcccattatgtttaaaatgtttcttatagatagcatatagttagaccatgtttttttacccactctgccagtttctgttttttaattggtacatttataccatttaaacttactgtaattattgctactttaaactcaaatctgtcatctttatgatcattcattgaaatattttcatcattcacccacaaacctgcttctcctcacttctgaaccttatttagtggcatcaacatctacacgttacctttttaactcaatcaaaaatactccattactttttcttccttacccacatttcaaattagtaacaaattcctagccactctacccccacccacaaatacctgtggaacttaccccctcatccctaattgtcacacacatcgtctaggtcttcaacactcatttaaatgcttgccatagtctcctaattgttttttctgcctctggtctctacccaattcattttctacactgccaccagccagccaggt[132 bp omitted]ccgggttcaaggggttctcctgcctcagcctcccaaataactggtattacaggcactcaccaccatgcccagctaatttttgtgtttttagtagagatagggtttcaccatgttgg[133 bp omitted]caataagattcttccctgtattgcctaatcttaacttttgactcagttccaattccctagtgcctgtgcatcctaccagccgtgcctgatacaggtctgtacactataaacactttcactttcatgtctctgtccctgctgtttgctttgccttcacagggcaaagccctacttatccttcaagattcagctcaaatatcttattattttccctgaatccagcagataaaattgttcttcatttgtattctaatagtacatcataggtacttttatactgatattaccatgtctttcttgttagtctccctggctaggctctgggctgattgaaggcaaagaactgtacttcacagattttagtatccttggaatctaattccattcctgactgtagcaggcccataatcatgttgaattcctgcctgtggaccttattcctattgttccccttatttggatgccttgatcatctttctattcaaagcatgcccattcttcatggcccgcttcctccataaagcctcactgactaatgtagcagagataattttaactgctttgctttagggaaaagggcttgcttttattagtttaatttaccatacagtttccaggcattgattactattaaaaatagagactatctgtagtatcttttattgcgcttatttcagcaatcctacttatagatcctcagctacatccatctaaccccaaacagacctaagtaactcacaattttattgaatacaaagcctttttacatgagaaataacatttatatccattgttttcaggaagagatcatttggggtttgtttcccttctgtcattttatttggggacagttaaaagaggcttctatttcacatgccattagagtttgacaccagaaattatcttctaacctagtgctagccacagtgaggcacagtaaacacaatggagtttatgttcctgatgtgtgtattctttttttcttatgatagtgatatctttttcatctcttttgaagtactttttcagtcttttgtcttagcatctgtgtggaatataatatataaaagtattgtacagtcgaacatacagagtgatgtacccaagatcactcacctgtgcattggtaatgccaagcctagaattctggctactttctgtttctgttaattttcaaaattagctcaataaatgtaagaaagacaggaagaggtgcatgtctaatatgctccattatcttagacacttataaagtagggatttttttaatagttgggttttgcagagactgttagacctcatggcttctaagaattgataattgcatcagattgcaaatatgaatatactgtatccattttaataagtataaaatttctttttgatactagaagctgtaagtatgctatgtacctagaaagtaatgtttttcttgcaaatttatgtttaatgtgcatgactagggaacattagcataggtgttgtagcatttaactgctgcttaaaatttttgagaataggccaggtgcagtggctcatgcctataatcccagcactttgggaggcccaggcaggaggattgcttgagtccaggagtttgagaccagtctgggtaacataacaagactatgtctctatttaaaaaaaaaaaatatatagccaagcatggtggcatgtacctgtagtccagctacttgagaggctgaggcatgaggatcacctgagctcaggagtttgaggttacagtgagctgtgatcaccactgcactccagcctgggcaacagagcaagaccctgtctcgaataaatttttttgagccaggcgcggtggctcatgcctgtaatcctagcactttgaagaggccgaggcaggcggatcacctgaggtcaagtgttcaagaccagcttggccaacatggtgaaacccggtctctactaaaaatacgaaaattagctgggcatggtggcatgtgcctataatcccagctacttgggaggctggggcaggagaattgcttcaaccgggaggcggaggttgcagtgagccaagatcgcaccattgcactccagcctgggtgacaagagcaaaactccgtctcaaaaaaaaaaaaagaaaaatttctgagagtatatcattagaatctagaacttgggtaaaggaagttaactataagggagtgagagaatttttgtgaaatgtaggtatgcagtatttgatacagatttgtcttggtactattaatagcctcactttacaaatgaaggtttagagctgttaagtaactcaacaatttcacacagtcatagcatcagtattagaaccctgctctgtctctagagcttatgtttttaaccattatgctccaatagttgacatcttgaggtctgggactatgtcttcattcactctagagatatttattaagtgcctactatttttattaatcactgttctaggagctagagatatagtaagtgaacaaaagagacaaaaatatctgtgaacaagagacaaaaatagaatggagcatacattctagtggaagaagacagaaaataagtaaattttataatataaagttgttttttttttgagatagagtttcactattgttgcctaggctggagtgcagtggcacaatcttggctcactgcaacctctgcctcctgggttcaagcaattctcctgcctcagcctcccaagtagctggaattacaggcacgtaccaccactcccagctaatttttttgtatttagtagagacggagtttcaccatgttgatcaggctggtctcgaactcctgacctcaggtgatccacccgccttggcctcccaaagtgttgggattacaagcgtgagccactgtgccaggctataagttaattttttaaaccactttattgaggtatgattggtattcaaaaagctgtatgtatttattatatagaacttaatgagtttggagataagtatacaagcatgaaaccatcaccaccgtctgtgccataacccaagcatcacctataaaagtttattctcatcctcttatttattaagtatacgatacagtattgtaaactgtatgcactgtgctatataatagatctctcaaacttaatcattttgaaagtgaaactttgtaccctttgactaataccacctgtttcgccagccccaaggccctcgcaatcactgttctactctgcttctatgagtttgttgtttctagattcatcatataagtggcattatgtagtatttgtccaaaaagtatctggcttaatttcacttagcataatgtcttccagtttcattcatgttatcacaaatgccaggattttctttttatgactgaatagtattctgttgtgtgtatatgccacattttctttatccattcatctgtcaatggacatttaggttgtttccatgtctaggctattgtgaataatgctgcagtgaacatgggagttcagatacctctctgacatactgattttatttactttaaatatatacccagaagtggaattgcaggatcatatggtagttctattttaagttttttcaggaactttcatactggttttcatagtaggtgcaccaatttacattcccatcgactgtacagggttccattttatccacatcttcactaatacttgttatcttatatatatatatatatgtgtgtgtgtgtatgtgtatatatatatatgtgtgtgtgtgtatatatatatatatatatatatatgtatatatatataatgttcatcctaacaggtgtgaggtgatatatcattgtggttttgatttggaaatcaaatcacctgattaattggtgatgttgagcaccttttcatgtactcattggccatttgtatgtcctctttggagaaatgtctatttaggtcctttgcctattttaaaaattgggttatttgtttgaattttggggtttttgacattcagttgtaggggtttcttacatattttagatatcaaccattcattagataaacggtttgcaaatattttctcccattctgtaagttgccttttcatgttgttggttgtttcttttgttgtgcagaagctttttagtttgatacagtcccgtttgtctatttttgcttttgctgctggtgcttttggtgtggtgtcatatccaagaaatcattgccaagtccaatgtcaagaagtttttttcctgttttcttctaggagttttacagcttcaggccttacatttaagtatttaatacattttgagtttatttttgtatatgatgtaatataagagtccaatttcatttttttgcatgtgtatctccaaaggtaatcagttttgtgaagaaaagtaaaacaaagtgggatggcagggagtaaataaggtgggtgagcaaagcttcactgagaagttgttgttcgagcaaagtacaaaggaggtaaggaaatgatcatatgataagaccattccaggtagagacagcagcaagtgaagctgctataaggcaggagttctggtgtgctcaaaaaacagcagcaagggcagctggagccagtgagtgagaaggagaggaaaatagaaaaggaaaacatagagatgtcgatgcggggatcagaacatataggacattgcaaggactttggcttttgctctgagtaagatgggaatcagtgggttttcaaacagagaatgacataatctgatttattttaaaaggatcattctgacttttatactgagaacaaactataagaagataaggaccaggcatggtggcttatgcctgtaatcccagcactttgggaggccaaggtgggcggatcacctgaggtcaggagttcaagaccagcctgaccaacaaggtgaaaccctgtctctactaaaaatacaaaaattagctgggtgtggtggcaggtgcctgtattcccagctcctcgggaggctgagacaggagaaccacttgaacctgggaggtggaggttgcagtgagccaagatcacaccactgcactccaacctaggtgatggagcaagactccatctcaaaaaaaaagataagaaatgtcttgttaattctggtattccaaataagcaatacagtatatctgctacatattgtatgtgctaatgaatgtcaaaagccttataattttccata[132 bp omitted]gaaaccccatctctactaaaaatacaaaaaaattagctgggtgtggtggcatgtgcctgtagacccaactgctcgagaggctgaggcaggagaatcacttgaacccgggaggcggaggttgcagtgagctgagatggtgccgctgcactccagcctgggcaacagagcaagactccgtctaaaaaagaaaatctttagataattagaacatttgagtgtggattagatattagatgatataaatggtattttttaggtatgagaatggcacggtaatcatatttaaaagaagggttatcagaggtatatatagaagtatctactgataaaattattagtgtctagatcttgctttcaatgctgcagcaaaaataaacaaaaatgggaagactgataaagtaggtaaaattttgataattgttaaagcaggtgatggatgcatggggttcaatatattatatggagttcattatactcttctatctacttttgtatatatttaaaatgcccataataaaaagacagtggccgggcatggtggctcatgcttgtaatcgcagcactttaagaggccaaggtgggaggatcacttgagcccaggagttcaagaccagcccaggcaacaaagagagaccctgtctctacaaacaaacacaacaaaaattagctgagtgtggtggcacatgcctgtggtcccacctactcaggaggctggggtgaaaggatcgctggagcccaggaggcggaggttacagtgagccgaggccatgccactgcactctagcctgggcaacagaacaagaccctatctcaaaaaaaaaaagaaagaaaaatatatgtatataacattttacttggtaattctacctttaataatttatcataaaggaataatcaagaaaaaataaataccaaaaaatagaacaaaaaacaaaaacaaaccaaaaaattattagatattctgaaagataagtaagaagattctcatcttagtgttttcataatagctaaaatttgaacaacctaaatttctaacagttggaaaataaaaactggtataacccatgcagtaaaatacatgcagtccttaaattgttttcaaagactatttaatgatgttaaaaatggtcacaataaaacataaagtgaagaaagcagaatgtgaaattggatacaatattaccacaattttgactaaaaagtacctataaatatacatatatattttaagggataagagtctccctctgtcacccatgctggagtgctgtggtaccatcatagcatgttgtgacctcaaacttctgggttcaagcaatcctcccacctcagtctcctgggtagcttgtgctacaggcaagcaccaccatgcctggctttttttttttttttttggggacggagtcttgctctgtcacccaggctggagtgcagtggcgcgatctctgctcactgcaagctccgcctcccgggttcacgccattctcctgcctc[222 bp omitted]atttgagagaaactgctctagccgtctcagtacatcctctccaccatgaagtaagctccatgagggcaggaatcttttttttttttttttcttttcgctctgtcgtccaggctggagtgcagtggcacgatctcggctcactgcaagctctgcctcctgggttcacgctattctcctgcctc[135 bp omitted]ggcctcccaaagtgctgagattacaggcgtgagccactgtgcctggcctatttttttaattaaaaaataattttgcggctaggcacagtggcttattacacttgtaatcctggcactttgggaggccgaggtgggtggatcagttgagatcaggagttcaagaccagcctggccaacatggtgaaatcccatctctactaaaaatacaaaaagtagccaggtatggtgaccgccacctgtaatctcagctacttgggaggctgaggcatgagaatcgcctgaacccaggaggcagaggttgcagtgagccaagatttcaccactgcactccagcctgagtgacagagcaagactccatctcaaaaaatagtaataataataataatgattatttttgtagagacagtctcactgtgttgtccagtctggtctcaaactcctggcctcaagcaatcctcctgcctcagcctcccaaagcactgggattacagggacgaactaccgtgcctggccctataaatatttatagataaaagactttgaggaaatatgctaaattattaataatattctttatctctgagtgataggatttcacatcttttgattctttatactctgtttttctaaagttttcttttatgcttacctacttttattaaaacaaatggaagaggggaatgtaaattagttcaaccattatggaagacagtgtggcaattcctcaaagacctagaaccagaaataccatttgacccagcaatcccattactgggtatatacccaaaggaatagaaatcattgtgttataaagatacatgcaggcatatgttcattgcagcactattccatatagcaaagacattgaatcaacaaaaatgcctatcaatgatagactgggtaaagaaaatgtggtacatatataccatggaatactatgcagccatacaaaggaatgagagcatgtcctttgcagggacacggctggaactggaagccattatcctcaacaaactaatgcaggaacagaaaaccaaacaccacatgttatcacttataagtaggagctgaacaatgagaacacatggacacagggaggggaacaacacacagtggggcctgtcagggggatgggaggagggagagcatcaggaacaatagccaatgcatgtggggcttaatacctaggtgatgggttgataagtgcagcaaaccaccctggcacacgtttatgtaagaaacctgcacattctgcacatgtatcttggaacttaagaagtattattttttaattcaaaacataaaaaaaaagagactataaaagtttcaggtttaaacttt[136 bp omitted]catagtggaaccctgtctctactaaaaatacaaaaattagatgggtgtggtgctgtgtgcctataatcccaggttctcgggaggctgaggcaggaggattgcttgaacccaggagacagaggttgcagtgagccaagatcgtgccactgcactccagcctgggtgacagagcaagactcagtctcaaaaaaaaaaaaaaagataaggaaatagtcaaatgtggataaagattcaaagattcatgttccagggcattcattgaattgctgggttttatttatttgtttgtttttgttttttgtttgtttgtttgtttttgagacagagtctcgctcaggttctagtgattctcctgccttagcctcccgagtagctaggattacaggtgtgcaccacgcccggctaatttttgtatttttagtagagatggagtttcaccatgttggccaggctggtctccaactcctgacctcaggtgatccggctgcctcagccttccaaagtgctgggattacaggagtgaaccaccacgcctggccgaattactgtttttattagcagaaaagttggaaatgtctaagtgaccaacaaaggaagaatgattaatcgtgatgcatccatattatgcagctactaaatgttttcaaagcatgaaatacagaaaatgctcatggtataataggaagattggtaaatttcatgtttaatatgatttcaaatacattttttaaaaatgaaagattgaagagagacaaaacgttagcaggtttggggtgatgttaatttttctgtttttttttttttgttctccgaattgtctacactgatc[132 bp omitted]aacgccgtctctaccaaaaatacaaaaattagccaggcacggtggcaggcgcctgtaatcccagctactcaggaggctgaggcaggagaatcacttgaacccagagggcagaggttgcagtgagccgagattgcaccactgcactccagcctgagtgacagtga[143 bp omitted]tctaccaaaaatataaaaaattaaccaggcgtggtggcatgtgcctgtaatctcagctacttgggaagctgaggcagtagaatggcttgaacttgggagacagaggttgcagtgagccaagatcatgccattgcactccagcctaggcaacaagagtgaaactccgaatctgatttgtatgtaatgagggaagcctgtttagctgtatgtctcccagcagtgctcactagtctggtagtaaaattgaggggggcgaggatggtagtcatctagcattagaagtgcttggcaaaggttacaggagtctgtgttggtggtctacctccatggttgatgtgaagatgttttttataaactgtaaagttctacacgaataatagtggtagtttttaatctatccccatgccactgtcctcattcaagccctcattattcttacttaaacttattgactgcttttcctgcctccatgctctctccaaaccatcttttacattactgcccagagttctttttctgaagcaccggtaagatggtggtggttttttcctttcagaaacctgtgttggctctccatgtctgaacttttaagccacaaatttgaggcctttttattgtttattttattttatttatttatgtatttttggagacagagtttcgctcttgtggcccatgctggagtgcaatgctgtgatctcagctcaccgcaacctccacctcctgggttcaagcgattctcctgccttagcctcccaagtagctgggattacaggcatgcgccaccatgcccagctaatactgtgtttttagtagggacggagtttctccatgttggtcaggctgatcttgaactaccgacctcaggtgatctgcctgtctcggcctcccaaaatgctgggattacaggcatgagccaccgtgcctcgccaaggcctttttgaatgtgatcccaaagtacctttctaccctaatttctgactacatctccatatactgttttctctgtcctcatcatcctacctacctttccctaaatatgcgaggcttagctaaccctctgttcttgctcatgctatgtcatgtaaaacatttgaaggacaaactttggacttacagttagatgacttgtattactgctttggttctgctgttcacaggtggctgtgtggcctttaatatattattttaacctctttgatcctcaggggtttgttgtgtgttttgtttgtttgtttgtttgtttgtttttactaatttcttcatctttatactgttaatacctacctcaaagaattgttagaatttattcagataatgaatacgaaagcacgttgtaactagatgcacagtacacatgtatggcattattttctacctacctctgtcagtatgcttttgacttcaaataacagaaatccaactgaaaatggcttaaacaatgaggaagcaactctggaggtaaggcggttccagggttggttaattcagcagctcagtagcatcgtcctactatctccctgctttgtactctttgttttgttcctttcggctttttacactatggtcttaagatggctgctacagtcttagttgtcacatgaagtcagcaatgttcagatgcaggaaaggaggagtcctattagtatgaccctctttaagggtgagaaaatctctctagaagccttccctcatccccaccccataaactttgcccaatgtctaattcatggaaattgtaccacatgcctaaccagtcatcactgggaagggaaatcagctaatcttcattagcttagaccaatcatgattcactcgctggtactggccgtcacctctcctgaaggaacagatgcttattaggggctctattagggagggaaaagattgtgacagcacgatgtcttcagggatgaccctggtttgttagggcaaggagatgaaaggaagaggtgctaagtagtaaatcagcataaaggggagcttgcttttggtgactcaagatttcaatcaggcatcatacaaaatgctgagagaacagatggggtgggaagaatgtgaaactagttttacattgcagtttcaaagtttatctttatatccaaataggtatgcagtggaactgatgaagaccctgatgataaaaacgcaccctttcggcaacggccattttgcaaatataaaggacatactgctgatctccttgatctttcatggtctaaagtaagaaattcttatttgaatcatatagtaattctgcgtataaggagctgatgctgtagtcttaaagcagaatttcttctccgggaaacctcagttttttgtcttaaggccttcaactgattggatgaggcccacccacatagtcaagggtgatctcctttacttaaaatcaactgattataggtattaatcacatgtacagaataccttcacagcaacaactagattggtgtttgattaaataattgagtactagcttaataattaaataattgagtatagctaagttgatacataaaattaactgttataaccaccttcttaccagaattaacaccttttctttgaactcattctccttaacctttctctagcatttgatgatttgatgctattgatctttcttgaactacttgattttggagcactgtatgttctagattcccttcctatctcactgactattcccttgtttccttcatggaggaaatatgtaatagttaaaaaaaaaaattgagaacctgtgcaactatacctgctatgtaccaagtacttttcattcactcaaaacatatctgttgatcattttaccacctggttaagaaatgacccctggagccagactcccaaggtacatattcttcctagtctgccccttacattatgtgaccttgggcaagttatttaacctcaccatgcctcatctgcaaaatagacataataaaaataccttcctcatagtgttataacagggaaagattaactgagctagtaaatataaagcacttgcctagaacataataaatgttcaattaatattagcagtgatgataatgattaactgagctagtaaatataaaacacttgcctagaacataataatgctcagttaatattagcaatgatcgtcatcatcatcatcatcactatctgccaagtagcattttagccactggggacacagacaaaagttaagtactttacatgtgctctgttcgtaccctcaaaacaaccttatgcgattgttgatgtttccttatcaaggatttaaaaccaagggtcatacgtgttaaagaacatgcttaaaggcgtatagctagggagatacgggagtttaggttcaaaccctatgacttcggagcattactctctagcccattccagtgtcacagtagctaatcactacaaggaaacaggatgacaaaaataacaaatgttggacacgttgaaagatttaagaaatcataaattttttatactttccgttttatactttatttccattctatctcttaggaggcagcagtaatatgatttagtatctatccagctacctaattgtctcaagtgagtaatgtgcatttttaaggactggtgccagcctataaaccacctggtcttcctggtccttgacgatacaaatatagaataccagtctgtgaagagataagtgcagaaaccaagagtaaactatttagaagtgtttatggcagttttcacaataagtttatacctgtttaatcttttaaaacttgggcttctattttgtataataatacaaaatggggcttttattttatatgacttttatttttatttcatttttctagtaaatgttttctgtattttaaaatagtttcagtccacaactcattggaaatttaaaaaaacaaaaacaatccttcaccagaaatagtctgagaagcactagtctagatgagttatttcaatgaggtgctgccccatgcaggaatggttcctaaaggtctatcctcatatccccaacccctccaccccacctccatccagaggaaaggaacaaaatttctgcaacaagattctaagcctctccagggtaggaaccagatattattttactgttttttgcttttcaaacaccaactcaaaccagatattgtttctctttaatgtctatcacagtgtttttagtgagttttctatttgttgaaggtgtattttgtgccaataacaagaattaccgtgttaattcttacaataacaaccccgtgaggtagacaacctgattttgtctcgaggaagagattgagcccctgtgacctatctaaaatcacaaaattagttatgggtagaacttagattttaatctaatttatctgacttctaagatcagtgcttagtttaagaacgttatttaatttcgtttatttaataaaaagtatttattaaatacttataaaagaacaagtctttcttaaagaatacttatttggaacaagtcttaacatgtcttcagcaccttcacttaatattttagggatgtcttcatacctctttcatatgctcaaagcaatgagctattgcaggaattgaatacagtcagtttctgttttttgtttttttcttctgttttcttttttttgagacagagtctcgctctgttgccaaggctggagtgcagtggcacgatctcagctcactgcaacctccatctcccaggttcaagcgattctcctgcctcagcctccccgagtagctggaattacaggcgtgggccaccacgcccagctaatttttttttttatttttagtggagatggggtttcaccatggtggccagactgatctcgaactcctgacctcaaatgatccacctgcctcagcctcccaaagtgctgggattacaggcatgggccactgtgtccagccaaataaagtcagttttaatgaacataggttcatggtgtgccataggttaagtttttatacagttggtattaatcaacaggaaattataatgcaaactgcatatactcttaaaaacttttctggaactgagtggatcttgaaaataaaaatgattgttagatatttcaaagattattgtaaatttccaaattctgttttttaattctttacttttaatcataaagtataccatctatttgaaaacaggtataccacaatgtacctacttcatagtgttgctatataatgcgaagaacaatgcttaacacatcgtaagtatgcgatcaatgtcaccattgccttgatttgtttagcacctttaggcacaccaaagaatacagaggtatcatttgagttttctcattcagtataactcatagttctcctccttaaatagattatgttgaggaattaatgagcttctgccagctgaaagcttttgacagatagatgtttgtttcctgggcgatggggccatcacggtgcctaagtcagttacactaccatcttctagccttgaacattctgtgatctattctgaaagatttgacaatttctattctctaattttcttgcctagagtgtgacaggtgcacaataacttttcatttccatgctgcattatagggtaatctttttgaagacattttaaatgacaattagagatctatgtgagttaaaattcaccagtgttatcaatgtgaaaataactgaagtgacaataaaatgaatagatgccttatactgatagctaagttccaatatgtgcaggtgataacaactaaggcacaccttagttctctgctggtgcctggcagatttctttagacattgataagattcatctgaatttcagaacaggtaatgtcaaaaagttttagaatcagtgaaatatggtacttaactgtttgggggaaaataggatcttccaagtgaatttgataatcttttgttctttccgatgctgcatttaacaataacaaaactgttgagatacaaaaaccaaaagttcacttttattgtataaatagggttctttttcatatagtgataacatagtcaatgtcattttccccatagaactactttcttctttcttcttcaatggataaaacagtcagattatggcacatttctcgaagagaatgcctttgctgttttcaacatatagattttgtcactgccatagcttttcatccaagagtaagtaactatttatacatgtttttgttaacctctaaggaaggtgagagaacctgatttctctagagggcaattggactacaggaaaaaaattattaacagctacatagttatgagcaatttaattttgtgtttcattttgctttagaaatgagaaaggaaatattctgctgatctgcattagaaaaactggggatattatatcctaaatctttattaagacatgcaaggtataaataaatgaaataaagtatcctattaaagatgagagatattggagatggaggaagaagagacagcagatggataaatgagaaagggaagtacctaggcagaaataatgagaagattggggagggaagagacagagaaaaagactgaaagaggcaaagacgaaaattcattacaagatacactgaattcatattgttagtcttgatatcccttctttattccttttcagtatagaaaatcctttcatatctttcccccagaaataaagtatttcatatgatttcagccaaatgagaaaaatctgctgtcatggaattgcagacctattgtatgcccttagaggatggagccaccaaatgcttaaggctaaattagttacagatttttgcaactgtaagcaaaagggaaatcacatgttggtgctgactgcactagctctattaagcagaggactcgagctgaccctagcaacaagtttcccttacctaagttggtgttatgattacatttccagtggtgtcctcatctttatatgtttaacacacattatctttttaatgtaacattttaatcatattcacatttcttcatctcccccaaattaagaagactgacttgttttcaatatactttccttccctgagcaggcttgtaacataagcagtgataattccgaacccttgaagacttggttaagggccaggcgcggtggctcacacctgtaatcccagcactttgggaggccaaggtgggcagatcacgaggtcaagagatcaagaccaacctggccaacatggtgaaacattgtctctactaaaaatacaaacgttagtcaggcatggtggcaggtgcctgtagtcccagctactcgggaggctgaggcaagagaatcacttgaacccaggaggcagaggctgcagtgagctgagatcgcgccagcctgggcaatagagcgagactctgtctcaaaataaaaaaaaaaaaaagaggaagaagacttggttaagaattttggtggctcacgcctataatctccgcactttgggaggctgaggtgggaggatggctttaggctgggagttcaagaccagcctggacaacacagtgagaccccacctttatcacacacaaaaaaactatgttaattcttaccagttttgatgatcaagtcattagagtcctgtttctgaataacacccccatccctgttccctatacacacaacaaaaggatggatttaccccatcagcaactgtgagcaaaatctttccatccataaatctttccataactattttagctataaagtatcagcttggaaagagatatttggttgtgttcgttttctttctctttcttttcttttcttttctttttatttatctatttttggagacagggtatcactttgtcacccaggctgtagtgcagtggtgcagtcttggcttactgcagcctcaacttccctggctcgggtgatactcctgcctcagctccccaggtagctgggactacaggcatgcaccactatgcctgcactatgcctagctaatttttgtatttttagtagagacagggtattgccatgttgcccaggctggtctcaaactcctaggctcaaagcgatctgcccacctcggcctcccaaagtgctaggattaaaagcatgaaccactgcacccatccagttgttttccatgtggtattttattatttattaaactttctgttcagccatgtttttttttttttttttttttgaagacagtctccaggctggagtgcagtggcacaatctcggctcactgcaacctccacctcccgagttcaagcagttctgcctcagcctcccaagtagttgggattacagacatgcaccaccacatccagctaattttcatatttttattagagatagagtttcaccatgttggccaggctggtctacaactcttgacctcaagtgatccgcctgcctcagcctcacaaagtgctggaattacagacgtgagccactgcgcctggcccagccaatgattttttatagtgcttttatttggttttattttggaaactataaagccctatttctaaaaatcgtactgacctggagtgtttttaagaggggctaggaaagaatagggtagtgatgcctttttttgggggggaaatatgacttttattataatgttaaaggaagaaaggta[142 bp omitted]tctaataaaaatacaaaaattagccggccgtcgtgttgcatgcctataatcccagctactcaggaggctgaggcaggagaattgcttgagccaaggaggcggaggttgcagtgagccaagattgtaccactgtaccccagcctgagtgacagaatgagactccgtctcaaaaaaaaaggaatagcaaaatggagatacacatacatagatgtatgtatgtgacaattctgaattagaagactaagttaaagtatttttacttgttcacctcttctactggtacacattgagtgagcttacattatttgtagattgtctttgacaggtttcagagatgggtaagaataataatctttggcaaggaacagaaacccttagggcagggggatttggggtgggggaaggaaaaaaaaagaagaagaagaatcttggctgggtatggtggctcactcctataatcccagcactttgggagtttgaggcaggaggatcacttgaggccaggagtttgagactagcctgggcaacatagggagaccccatttttataaaaaaatttaaaattagcccggtatggtggtgtgcttctgtgatcccaactacttgggaggctgaggtgagaggattacttgagcccaggaggtcgaggctgcagtaagccgtgatcgagcctctgtactccagcctgggcaacaaactgagaccccatcaccaaaaaaaaaaaaaaagaaagaaagaaagaaaaattcttatgttgccaaaaacaaaacaagcttagtggtaggactgatttagtttaaaggagatttctcaatcctagtactattgacattctttgttacacgggggagagtaggctgtgcgttataggatatttagcagcatccctggtctctacacactaaatactggtagcatcctgatcctcccaccagttttgacaaccaaaatgtctccagataatgctagatgtcccctgcaaggtcagattgccgcaggttgagaaccgctgatttgagagcagaatttgaatgatgaagtaattctctgttgacatggtgttagagttccaaaaatgactggttttgggggccactaactgatgttactctttatccaagtgttacatgtatcccagaggaaggtatgatataggatagtgtttcccatagcatgttcctgaaaggtctagcacctcccgtaaacacgcccccccaaaaaaagtctgtggttaaatatgttgaaaagtgctacctactttatcctgtttggagattcaaaatgcaggttaactgagaatcatgtttaactttttgtaacccagaatttctcaaacttatttgatcacagaaccttcttccatgcaatacacactcaaacactttatctattgacatccatatcttgcaaaacagcagtttaaggatatgataattagaattttatttctccaaagtgaatagtgaggtttcttattgttgttactgctttcagtgcataaaataatgcttgcttaaagaataaaaatttttaaatgaaatctttttttttttttttttttttttttttttgagacggagtctcactctgttgccaggctggagtacagtggtgcgatcttggctcactgcaacctccacctcctgggttcaagcgattctcctgcctcagcctcccgagtagctgggactacagccgcgcaccaccatgcccagctaatttttatatttttactagagacgaggtttcaccatattggccaggatagtgtcgatctcttgaccttgtgatccactgccttggcctcccccaaagtgctaggattataggcgtgagccaccgcacctggccctgaaatctacatttttaaactattctaatagacttactgatttgatttgctaatgagttttttcttgatgtggtaaaatgaaaactttctctgttgccacctctttaggatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagaggtaaatgattgttttttgtaaattatataattgtatacttagtaaacactttcatggttttggacaagttgcttatcccctctgggctttaactgcattttctctaaatagagacaaataataccatgtctgtcttaagagttggaacagatgacttttgagatgtcttctaattctaatttaaaaaaaatttttttttgagatggagtctcactctgttgcccaggatggagtgcagtggagcgatctcggctcactacaacctctacctcctggattcaagtgattcttgtgcctcagcctcctgagtagctgggactataggcacgtgccaccacactcagctaatttttgtattttttggtagagatgggatttcaacgtgttggccaggctggtctcgaactcctgacttcaagtgattaacctgcctcagcctaccaaagtgctgggattataggcgtgagccaccacgcccaagcaaaaagaatttttttatagagacaaagtctcattctgtcacccaagttagagcgtagtggtgcaattgttgctcactacagcctcgaactcttgggctcaagcagtcctcctgcctcagcctcctgagtagctagagttacagatacgagccaccacacatgctcctaattctaatatgttaaatgtatggtttatttttagcatttgaaataccatacacaaatacatgtccgatctactagagggcgcaacaaggttggaagaaaaattactggcattgagcctttacctggagaaaataaggtactacagtattcaaaaccatctctctccatactatatgtagattcttgaaagttcttaatatcttggcaaaaaaatgtattctctttgttgtggaataccgcttttcttctagttttgaggtatattagtttgtatgtgtgtaacaccctttttgggttgtagcttagcttgtactaaaagatgatatttttaacttttcatttgatctacttttagatattggtaacctcaaatgactccagaatcagactatatgatttgagagatttgtcactatccatgaagtataagggttacgtcaatagcagcagccagatcaaagcaagtttcaggtaaattggcaatgagatgttcccaaaagagatcaggacatttctcccctagttccatttttccattggtctatgccttatgtttaatggggttcttttcacttttgcaagtagtagtttattatcatgcaatacgtaccttgtccacctatatagtatatagaattcgaattgaccctgttctgcaaatgaagaaaccaagactcagaaaattaagtgattggcctaaagtcatggttgtagagccaagattatgaagactctcatctctagagtttttgcttttgtacctttgtttacgcttttaagagggggcttacggctcatcccgccactcccctccctgccccattgtcttgaaccttttaggaaaggaaggaaccttttaggattctaagaaagcattttaacaccccacagcacagggtcttgtattcaaaactttacatatcattattatttaaatttctaatttgggttctggacactctcctgaaatagggttagctaccttttcttctttctagccctcttcttttgccgttttcttaccagttcttttttcttgaattatacattaattaattcaattggtaaagtattctgctcctgtctttcacaccttaaatcatcattcctcccaacgtggattaactaacatcacagttacttagagctttgatgcaaatacaagtgccaggccactacatcacacgtacacatttagaacatctagagtgagaccatgggtctacatattcaacaagacccttcaagtgttattttaggtatcacaaagtaggaagcactgataaaggaaacctttaaacatatacacacacacattttatttgcttttcctttctccccaaaattcagccatgattttacttacctcgttagtggttcagaagataagtatgtttatatctggagtacctaccatgacctaagcaagtttacttcagtcaggagagatcgtaatgacttctgggaaggtattaaaggtaagtacatacttgcttttgtgtgtcttataagag[184 bp omitted]tagtggcacacgtctgtagtcccagctacttgggaggctgaggcaggagaatcgctggaacctgggaggtggaaattgcagtgagccgagatggcaccactgcactccagtctgggcaatagagtgagattccgtctaaaaaaaagacaaaaaaaaagaagaagtaaattcatttaggcattattttagagaggcagtttgacaatgataaagtgccttgcatttggctttgcttgttttatctatactaaggaagaactttggtctaaaatttgagaagtcagggaatttcagaacttatatgtgattttttttagaaaaatttttgggttttaaatcactcttagttacttctatgttagtttttaaggatatttggcatataacatacactatcgtgtttgtcttggtatccaatttgtcagttatcctgaagtaaattttttccacagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtaaatctttacttgtcctatatttttttctagtcagcacttagtagcctcatttatctcatttgagtataataaggttttcactagtataaagaatatttcttttttcttttttcttaagacagggtcttgctctgtcacccaggctggagcgcagtgacgcagtcacacacagctcactgcagcctcaaccaccctggactcaggtgatccttccacctcagcctcccaagtagctgggactatgggcctacaccaccatgcccagctaatttttgtattttttgtagagatgggatttcaccatgttgcccaggctggtctcaaacttctgggctcaagcaatgcacccacctcagcctcccaaagtgctgggattacaggcatgagccaccaaagaatatttcttgtttgcaacttaatggttgtcagatatccatttctgaacttttcagtaatatatttcctcaaagttttacctgttttaaattcacctgagaattaaaaatgagaaatttgggcctg[176 bp omitted]gaggcaagagaatggtgtgagcccgggaggcagagcttgcagtgagctgagatcgcgccactgcactccagcctgtgtgacagagcaagactccatctcaaaaaaagaaaagagaaatttggatgttcataactatgggtaaccattctctttagagaagtgcaaacaatatatgcaaatgtaaaacttctttattacctgtctctcctactagtctgtaatctctagaagacagagacttttcatgtcttatttattgctgtattgccagtgtctctcacaatgcttgcctacacatagtaggtgcttgatgaacatgtgctgactaaatgaattaaacccaaatgaagcagggctaatttttctacttgccacaagttaacagcttcttgagataggtggctatttacaagtttgtaatttcttgccatttgtagcatatatgctttgagaatgaatattaattccagttatatacaatgctcatattaggaagggagaa[145 bp omitted]catggtgaaaccccgtctctactgaaaaactgcaaaaattagctgggcgtggtagtgcacgcctgcagtcccagctactcaggaggctgaggctggagaatcgcttgaaccagggaggtggaggttgcagtgagccgagatcacgccactgcactccagcctggtgacagagggagactccatctcaaaaaagaaaaaaaaaaaaaaaaaagaccaaggtgagcagattgcttgaggtcaggagttcaagaccagcctggccaacatgttgaaaccctgtctctactaaaaatacaaaaagtggccaggtatggttgcacacctctgtaatcccaggaggctgaggcaggagaagtgcttgaactcgggaaggtggagttttcagtgggctgagattgcaccactgtactccagtctgggtgacacagcaagactctgtctaaaaatatatatatatggcaggcgttgtggtatgtacctgtaatcccgggtatttgggaggctgaggcaggaggtcttgagcccgggcaacatagaagaccagcccgggcaacatagaaggacacccaactcaaaaaatatatatatgattcttttttaatttttaaatcgattgcataatagtttattgactgtattgtctcatgctacagattacaaacaggtcataaagccacaggaatagatacagtgtacaaagagtgcttctaaagtatttgaatggtaaaaagttatcaagtactttaatctcaagtaatttttttgtagtattatttggactatctactccactcatgacacttttccttctgtctgtgaagaaaaattttgataacaaagatgaacttcagtctagcatttctttcagtacaagatacaaaaataaaccaagttagaatgattaaacctttactaaatgcctgtttaactgctgtctgttttctttttctttccttctcagaatcacatccagcttctgtcttctaacttaagtcatttacgttttttctttttttttttaacttatgaatgaatgaatgaatgaatgacatggtgtcgctctgttgccctggctagagtgcagtggtacaatcatagctcactgcaacgttgaactcctgtgctcaagcaatcttcctgcctcagcatcccgagtagctaggactacacgtactaccatgcctggctaattttttttttttttttctttttgctagcaatgagttctcgttatgttgcccaggctggtctcgaacttctagcctcaaaaaggttagtcctactttggccaaagtactgggattacaggcatgagacatcatacctggcctttttttcttttcttttcttttttccccagtgctacctttttacattccatatacttcccctgcatattccacaggaaattctagcttttaaaacaatttgaggaaaagtaaaaagtacagggttttttttaacttctcaaaaatataccacattaacaaggttcagttaactaactgggtccttttttaagaggcacaaattttagtggattgtactcagatttgtgtttgtcattttgtacccatgtaggtgtagtctaagaataagctctcttaaacccaaaatgtgggatcacaaaatatattcaattcccctctctctttgttcctgacgtgtttggcaattcaagcctcaattttccttatgtgtaaaataatgatgataacctagtttatagagtttcaataagaattagatatgacatgtataggctgggcatggtggctcatgcctgtaaccccaacattttgggaggccaaggcaggaggatcacttgagaccaggagtttgagaccagcctggacaacatagcaagaccctgtcttcacaaaaaattaaataattagtcgggcacagtggcgcatgcctgtagggaggctgaggtggaaggatcctttgagcccaggagtatgaggttacaagaaagctatgatggtgccactgcattccagcctgtgcaacagagtgagactctatctaaaatatatatatatatatatatatatatatatatatatatacttgtatgtgtaaaagtgcctagcaaaatgcctggcatgtagtaggcattattgttatcattttcattattattgtgtcttacaaagcattttatatgtatggtgaattattttcttctctatcctttctcatattcctaagttctttgctgctgctactactgcacagcactgctgtgagatatgccaaaagggtggtaaaggaatgttcaaaggcttaggatatgtttttagcacatctaagtgaaaccattttgtgtgactcatcctgtccacaactttccaattaaagtttggattattttcttcttttttaaatctcaaattaaaatctcagttttcacctatgtataatagagttagttaacactgaatttttttattaagtgcttttatgcaactggcaaatgtaagaggtaagcatttatgccattcagcatagttatatagcttttcagtaaggaccatatggcaaaaggtgctgtcagcattcacacagcaaacgtgtgtacttcatttcatggcagtttcagtatgtctgctatacaataaaccttactggcaacctcgctagacacccctgttagcaacagacttgcccagctgatccgattctgccagcactccagtcctggggctgaatgacacactagcttcttgccatgcaatgaagcattagatgacttagatgcctaggctgcctaggaataggtccaagcatccaggccccaagagactgtaatatcctcaagccagggaaagaccagctaagacaaggtaagtgaaagtgagcctcagagcagaggagagattcagcagaatgaaagaattacaggagccagccagaaaaggagactgaaaaggtggggagatgatcttctcccctgaagctggagggtcatgggcatgtgataattgtggcagcaggcttcatattcctttaaaaatcaacttaaaactattttttatacttttaaggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaagttggtctccaacacttgtttaaacatgactttatttttaattgacttcagtaaatcaaggaatgcaagaaaaataaactcttgttttaatcatttaaattttagcaccagaagaccagattttagatccctaaattataatgcattagttacatgccttaaaatttttttaattctagctttaaattgaacagtgctaagaattcatctatatgcttatatgttctttactgcatttgttttcagcatgtaagtgagaagttggggagccacggacatatccttgttgattagcacggtcttagagtgttctaggctttctagtaaattacatattatttgttgctttcttcttgccagtgctgtgctttctccctctacccttccccctcccctctcctcatctctctggttgctttggcttcctcactctcctgtactctccctgactgaattgttatgccattggctttctaaaaaccaggcacagtttctttaatctcaaggtctgggtggcattgtgattgatccagtgtttctttttaaaacttgatgtcttcagctctttgaggcagcttggctttcactaacttctgcctgagaacttgtagtcggctgtggtgttgattgttttaactgcagataatcagggtattattatatgactatctcgtgataggttttatgtggttacttgaccaaaaagacaaaacgagttgggatgcaagcttaaaagcataatactggccgggcgtggtggctcatgcctataaccccagcactttgggaggccaagatcacctgaggtcaggagttcaagaccagcctggccaacatggtgaaaccccatctctactaagaatacaaaaaattagctgggcgtggtggcgggcacctgtaatcccagctactcaggaggctgaggcaggataatcgcttggacccaggaggcggaggttgcgatgagccaagatcgcaccattgcactccagcctgggcaacaagagcaaaactctgtctcaaaaaaaaaaaagcataatactgacacttgttattgctatatgaatacactgaatttaaaaggtagcatcaaaatatatagaaaaaaagaacactatttctctttaaaatgagttttagatattctctataacgagtgatatggtattattaaaaaaaaaaagatcacaggttctagagtcaggtaaacttggatttgcttccttcccgttagcacattccttgggcaagttatttatcctacattactactacttccttatctgtaatatgggaatacctaacttaaattgcaaagatttgctaagaaatcatgtatgtgtaaagcttggtgcctaaccagtaggtatactcaacagatgtacatttcttgctgcctctcgcaaatccgtgagtactctctcagaccaaaaaaaaaaaaaaagacgatatatggaaacgctttctttttgagatggaattttgctcttgttgcccaggctggggtgtaatggcacgatctcggctcaccacaacctccgcctcctgggttcaagcgattctcctgcctcagcctcccaagtagctgggattacaggtatgcgccaccatgcccagctaattttgtatttttagtagagatggggtttctccatgttggtcaggctagtctccaactcccgacctcaggtgatccacccgcctcggcctccgaaagtgctgggattacaggcacgagcgaccacgtccagccagaaacgctttctagacatagggatttcatggacacacagcattttagggattgacatagggcacagacattttttaacacttttttaacagacaccatctactatccccacttcataaaagataaaacattttaatgctaaaaacataggccaagcactatcacataatcttagagcaaccaatagtctattaaaatgaatacacttgacttttgaaataagtaattatattcccttatttttcttacgataccatgttatatttttcaattaaggaaccaatattggtataattaactaaactccacgctttattcagatttcactagtttttacccatatttggtcatcatgtgtccttagacccctcttagccgtgacaatttctcagactttccatgcttttgatgaccctgatagttttgaggagtactggtcaagtattttgttgaatgtacctcacattgggtttgtctaatgtttttctcatgattcagctggggttgtggactttaaggaagtgaattgctcttttcattacatcacatcgagggtacgttcttatcacctggctgaggtagtgtccatcatatgggcacaatttaagcaatccatcaaacattcaggttgtgcctgttttttatcactgtgaataacaatcagagatagagaaatatatatcttgtcagaatttccaattattgatcgaaggtggtaggtccttaaaatgaaagtacaaagcatgaactcttaacagtaagcaccagcctgggcaacatggtgagactccgtctctacaaaaaaaaaaaaaaaaaaaaaaaaaatccagacgtggtgatgcatgcctgtggtcccagcgaacagggagactgaagcaggagaatggcttgagcccagggggtcgaggctgcagtgagccatgttcacaccactgtgctccatgtgctccagcctgagcaacagagtgagaccctgtctcaaaaaaaaaaaaaaaaagaataagcgatgtatgaattacaagaaattcctgcatagaaattgggaaccccaatttgtagtcctggttgtggtggccttgtgacttcaggaaagataagtagttctctgcaagtctattaaaatgaagtccttggactaagatttctaactctgatggtccatgtggtccatgtgcttgccggcagtccttcagaaacagtgcagctgaggatttcctcactttctcattcatttattcaaattcctgctgacataacttgtgatcttctgtggcatcagaatggcacaatcagtgactgagttctactcctagaacatctaattacaagatcggtatattgagaagcattttccctgattttttttttctcaaaatatgttcatcaactggatcagtatacactgtctcctctaggtggtacccaacatttaaaatactgcagtgtatattatttggataagaagaccaaaagcataatttaaaattgctaggagaaaatgccttagattttcaccatccctacttggagagggggaggaacattgcaacagatgtcagtgctttgcttctcttaggaccagaaccaaacagaaaggggaccaagaagcaagaaagaattgcgctattctattgaacctctgagcaggttgcaaatattaagtttttagtgaaccatgaaacctaagttgtttacaaaacaaagtgaagcagtgcaaattagaactgaatctgttttctaag[143 bp omitted]ctctactaaaaatacaaaaatcaactgggcatggtggcacgcacctgtaatcccagcttctcaggaggctgaggcaggagaattgcttgaacccaggaggcctctggaggttgcagtgggccgagatggtgccactgcactccagcctgggcgacagagtgagacctctgtctcgggggggaaaaaaaactcaactattttaagtatggccaaagtgaacttaaattgaacctacccttgttaagtcagagtccttaattaggacagtcttctctagagtgagttttgcatgaggcaaaaaagaaaggcacacttggtcagaatgaagctctgtgtgtggcaagagcaggagtgatgaagtggtatggcagcgagaggtacagacaactggagaagcagcagcagctgggacggacacaggtggcaatgggagtggaaggtggtgggaagcctcaaaatccacaggagatcaagttgaagcagatacagaagagaatcattccactttattgattattatggagtgatttcacccatagaatacgtgtgaaagtcaatcacaggtccttgtaagtaatgttcaacaaatatttgatctgaattgagtctgctgcagtgcatacaacaatatgaaaaagagtaattgaagagacattggaaactgacttccttgggtcagtttttgccttaacatggtcattcactaatcagtcgaataaaccgttagataaaccattaagtcagccaagcttccatgcaccttcattagggaaaggagttattttaagcttataagcaattctatgaaagctttcactcttgtgcactaacgtcaagagcaggatattttgtttttcctttttccaagtcatctcctttcaaccccatggggacttctaaaattgtggtctgctatgccttcctcagaagcacctgggaattagtttaacgtgcactgaatcacagtctgttggagaagggatgcaggaacctgttttcaacaactttaagaatccctgagctaggaatagaagtttaagcagctaactcattcaggtaaaggccaagagacagacaagtagggtcacgaattgcccaaggcctacagccagtggtgtactagtaaatgtttcacagtccaccctccaaaaaaaaccaaaaataaatttgtaatatttgctaatttccatggtgtaaatactcccacggtggccaattttaagctaacaatgtgacatcacctaacatggtgcactgtagcactgttacatagtatttgtaccataaagatacaataaatctcaagatcataaatggtagtacaacatagtaaaataatcaggaagtgatgagtttttagtaattattacctgtatctttattataacttcattgtaatattgatttaaattacgactgtgtttaacaaatggcttgcaaattttaatgatcacctctcaccattacctgaaaacattcttgaaaaagacacacatccctcctttggcctgtggactaatcagagcacatgagcaatctcagagaacctgccatgtgtcaagtgaggaaggagaagtgttaggggaggcattgtttacggatggatttggccagtaatcaacaatcaggaagagctattattgtgttcattccctggggcctatgtggccacacagaaccaagtaggcaacttagcctcctcattcagaggcttgccctagagcctgagctaagaaaaaagaccacggggaatgcactgcagcccacaggcaaactgccttctgcatcttatacatactctagcccaggatttcttcagcacagacgacctgcatgaagttgtgcttaaaatgtaatgtcttggccagacgtggtggctcacgcctgtaatcccagcattttgggaggctgagacaggcggaccatgaggtcaggagatcaagac[216 bp omitted]gaggcagcagaatggcgtgaacccgggaggcggactttgcagtgaaccgagattgcgccactgcactccagcctgggtgacagagcaagactccatctcaaaaaaaaaaaaaaagaaaaaaaaacccgtctttactaaaaatacaaaaagttagctgggcgtggtggcacgcccctgtagtccctgctactcaggaggctgaggcaggagaatcgcttgaacccttggagtggaagttgcagtgagctgaggtggcaccactgcactccagtgtgggcgacagagcgagactacatctcaaaaaaaaaaaaaaaaaaaaaaggcctgggccccaccccagacctccagaatcagaatctctgggagcctggtgtggaatttgcatatttagaaacacaccaagcaagtctgataagcactaaaattcaagaactcctgggttgaagcagctgtagttaagtatacatacccctgagggtacttgaagattttccaaggcatatgtaggcatagatagttttaaagtaatcaatttccagatcattcactttcgtatgtactcagattcccaaaatccatctgcctgaagaagtggcaacctgcagaatcttctttcccacctcccctttcatgattgccagtctctaccttcaaaaaaaaaccatacttcttgcccatcccaaaagttagtatggagcatggccacagggtgtgaaaacctccagagatataaataggacaatccaacatattggtgttggtgctgagaaaattagtgatactctgataatggggtagcatatctttttgccagtcaagtggtttctaatttattgctttcagtaacattgaaggaggacataattgccagctaatcattaaaaataactttgatcatagaatacttttttatatgtaacttggaaagggttcaaagaaatgggtggcattgctataaaaaaattccattctcgtctatttaaatttgtgaatgaggttcctcaatgcttatatctataaaagaaaagaaaaataggaacaaagttgatgttgaaccctgtctcccagcagtaagagtaatccacagaaacatgaactaaaaatggccccatacattttagagctgtgtttccaataaaaatgtacttctca[133 bp omitted]gaaaccctgtctctactaagaatacaaaaattagtcaagcgtggtgatatgtgcctgtaatcccagctcctcgggaggctaaagcaggagaatcgcttgaatctgcgaggcagaggttgcggtgaactgagatcccacccctgcactccagcctgggcaacagagcgagactccgtctccaaaaaaaaaaaaaaagaaaagttacgtttatgttgattgtctagtaatataaattgtaaataaataatttgtgaagctattttaattcagaagaaaagtgttaacattttagagcattgtgttgacagaaaattaaaaattatttcaagtttaatgtgtatctgattatttgctgcaaggaagtacgacaggatgacctatataaatactttcagaatacaaaagatatcattaggataaaaatatgtggaggaagaggaatggatttataagttcaaacagaaaagggaatgatgtatagccttcaactgttaaggagcttgtctttatgttttttagaggaatgatgttgtcaaattgatatggtatgagccctatggtatgataaacgtatcttaataaagttgttatttttaaaaagaaaactgctagggcagtaagattccaaaagtaatgtaagatttcttctaaaatatttacaaaatgccaaaattgcattctctccagtattttaacttatgatgtaaaagtttaaatgtcaattttaaaacatgtcaggaattatgtataacaaatgttgaagaccactggggtagaacatgaaggatgaggaagactggcataaggtaagctgggtctgggtccttttgagctttcacgcattgttctctctctctctttttattttttttgagaaggagtctcgttctgtcacctaggctgaagtgcagtggcacaatctcggctcactgcaacctccgcctcccgggttcaagcgattctcctgcctcagcttcccgagtagctgggattacagactcctgccaccacacccggctaatttttgtatttttagtagagacagggtttcaccacgttggccaggctggtctcgaactcctgatctcaggtgatctgcccgcctcggcctcccaaagtgcagggattattacaggcgtgagccaccgcgctcagccttcatgcattgttctgagagcaatgggctgctctcaatgtgaagagtggggtgggcagagggtgtcaagaacgggtaaaaccagaggctgagcaagcagctaggaaaatgtggcagtaatccaggcaagaaatgatagtggcttggaccagagtggtagcagtaggaggacaattccttcccaggattagtttgaggataaagtcttgagcatgaaaaggattgagtggggcacaactggaaactactagtgctgttattaaatacaaacctcataaagcaatacgacagcttatattgctaaaccaaattgcaaatcaacaagaaaagatagccatcggatatgctaacaacaatgcagtacatcatttggaaggtcatcattattcattaaaaaggtaccaaaatcctcccagctccatcagcaggtaaaaagacatttcaggtcttttatttaaactggtgtacactacttaggatagttacttctgaatttacacctagagggtctgtgtattgtagaccttaagctggggctccccagctgctgggccatggactggtaatgtccgtggcccattaggaaccggactgcacagcaggaggtgagcagcaggctggtgagcattttaccgcctgagtgccacctcctgtcagatcaacagtggcattaggttctcataggggcatgaaccctattgtgaactgcgcattatgagagggacctaggttgcaagctccttgtgagaatctaatgcttgatgatctgaggtggaacagtttcatcccaaaatcatttcccaccccaccccaccctaccatccgtggaaaaattgtcttccatgaaactggtgcctggtgccaaaaaggttggggaccactgcattaagcaattatctcttataaccttgtcccacgttcagaactgcataaaaattcatttgaagtcacagaaccatcacttggatcgagtccatccccctcaacttccatttctttggatgacagttttttgttgatcactttttctttcaacaattttgaaaataattgggaatggagtgatgtgtatggtattttgaaataactactaaatgtccatccccattcctgaaagtgaagttctgaaatatatatatatataatatatatgtaaatatgtttatatataaaatatatataaggtgacaaaatattacaaaaattaagtcaattatgaattaaaatgggctttttaatagaaaagtttttaaaaatttctttaaaatgatgctgcacatcagggagtagagtgtgttctggctcttccattagctttatgactttgggcaaatagcttccctctccctgtgcctcagtttccccatctgcaaaataagggattggacacaaagatatttcaatccctccagctctaactgtggtgatctcaccacctaatttacctatagctgtttctttttccctctaggcttgccgtttgtaggccattgtataatttcatttcacctccactagagggtggccagggaaaggagatgaggctcaaaccagctatttgtattctttgccggcaaaaaaccaaaaaataatgttggcagaagaaatcgatattacatggacaagaatgaaactgggatttcagttggtttcgtttgtcttagctgttatgctcctatgttatacaaaggaatcatgagagaggtgttttacataattttcttttaaattaatataaggaaatcaagcacagttgaccatccgtatccttggattctgcatccatggattaaaccaacctcagatcaaaaatattctaaaataaaatgaaataaaaaatgacaatacaacaataaaaagtaatacaaatgtttaacaatagagtatatctacacagcatttacattgtattag[143 bp omitted]tgaaacactgtctctactaaaaatacaaaaattagtcgggctcggtggtacgcgcctgtgatcccagctactcagaaggctgagggaggagaatcacttgaacccggaaggtggaggttgcagtgagctgagatcattccactgcactccagcttgggtgatagaatgagactgtgtatatacacacatacatatatacaggaagatgtacgtaggttatacaaatactacaccattttatatacgagacatgagcatccatgaattttggtgcccatgagggtcctggaaacaatcccctttggataccgagggacaactgtatatacttgcctcctccagactgtatgtccccagctaataaatacaatctctactaaatcaatcttcaagcacacccccttcccattctttgtactggaatttccagtcaagaattgtgatcaggaaccttccctgattccaatttgcttgccacagaaaattctagctctctggccaactttctgaccaattttgtttcccattacttcccagaaaatatcctctaccggaaagacacagcttttcattaagatcccacaaacgtagccttggtgttttcagggctgacctactgtgttgcgataacgctgcaagctggagtcaaaagattttagtgtaccagagcttgttagagaatggctgattccagggctgggcaaggtaagcacaaggtgagcctggagcatatttttatgccagaaattaaggaagtgctcaaaataaatgatggtggtatgtcacaaggacaggtaccaccttgaagggaccatgggccaaatctgggaaaattgagattcaaaataattaaatacagtaatgaattaggacatgttaaaaaattagtaaagatataagttcataccaataatagataaataaatcgctaaataaaatgaagaagggagagaactttacagtagaattcaattgtgaatgtggaagaagtactagaggtggaaaatcagtattttgcaaccatcatagtaaatattggttcagacaagagtcatcaatggatttagatga[143 bp omitted]gaaaccctgtctctactaaaaaatacaaaaattagccaggcgtggtggcaggtgcctgtagtcccagctactcaggaggctgaggcaggagaatcacttgaaccgggtaggcgggggttgcagtgagccgagatcacgccattgcactccagcctgggcaacacgagcgaaactctgtctcaaaaaaaaaaaaaaagtattacctcactgactgcttgttaattacatagcaaaaagaataactatacagtaaagaaattggacatcaccttgaccaagtgatcaaaactaatatcaccagtgggacagatggataacatgtgcctctggtttgacaccctgagaaagacccagcaacacttgcgtagtattccagctgagaatgcatcacctgaatataatcatgagaaaacaccaaagaaactccaaataagaaacacaattttttaaaaaaggactatattctctctctctctcttttttttttttcgagatgaagtctcactctgtcacctaggctgaagtgcaatggtgccatcttgcaacctgtgcctcctgggttcaagtgattctcctgcctcagcctcctgagtagctgggattacaggcacccgccaccacgcccggctaatttttgtatttttggtagagatggggctttg[141 bp omitted]tgtcctggtggagtgacttatgcctgtaattctagcactttgggaggctgaagcaagaggatcacttgaggccaggagttcaggagcaggctggacaacatggcggggtccctactctacaaaaataataataacaaaattaaaaataaaaataagttttaaaaaagacaaaggccgggcatgatggctcatagctgtactcccagcactttggaaggccaaggtgggaggattacttgagcccaggagtttgagaccaccctgggcaacacagcgagacttctacaaataacataaaaattagccaggcatgatggtgcgaacctgtggtcccagctactcacaatgttgaggcaggaggatcagttgagcctgggaggtcgaagctgcagtgagccatgattgcaccgctgcactccagcctgggcaatagagcaagaccccatttcaaaaaaagaaaaagacaaagactgtagaaatgtgtccagattaaaggagattaaagcaacatgacaaataatgcataccagatcctagattgaatcttggaggggggagatgatgctataaaggacattattggatcagttgacaaaatggaaatatggacagtagataagaaaaaattatatccatattaaattgaagttaactgtactgtggtcatgtaaacataatattcctagtcttcaaaatataccggcaggaggatcgcctgagttcaggaggtcgaagctgcagtgagccatgttcgcaccactgcatgccagcctggacgactgaagtctttaggggtcataaatcatgaaacttactctcaaatagatggatacacagagagagagcatgcctaaatgagccataatggtaataatagccgaatctgagcaaagagagtatatggggttcttcgtactgttgtttgtttgtttgttttgtttgtttgttttttgagacggagtctccctctgttgcccaggctggagtgcagtggtgcgaacttgccttactgcaacctccgcctcccgggttcaagcgattctcctgcctcagcctcccgagtagctgggattacaggcgccctccaccacgcccagctaatcttgtgtatttttactaga[142 bp omitted]ttttgagacccgatctcactctggcccaggctgaagtgcagtggtgccatctcagctcactgcagcctcggcctcccaagtgatgctcccacctcagcttcctgagtagctgggactaaaggcgcacaccaccacacctggctaattttttgtttttttgtagagacaagatttcaccatgttgcccaggctgatctcaaacttctgggctcaagcaatccacctgccttggcctcccaaagtgctgggattacaggcatgagccactgtgcctggccaggctggcttcttaggctcaggttcaggtctgctccatgtatctctcatttcaggacccaggccaaaaaggaagtagttacctgtggcatgcttgtcttttagcggatagcaggaatacaagacgcctcttaaagcctctgctcagaactgatacactatcactttggcccattggtcaaaataggacacctggccaagccccaaattcccggaatggggaaatatactccaccaactctactgggtgggatgtactacaaagttgcataacagagggtgcagatggataattctctagggagaaggaagaaatgagaataataatccaatattctagacactcttgtccatacaccagagtagagttgaggtggctgtgaagtcctgtttatgttattctgattataattattcgtgcatttgtgactaacttatttaagacctatctcttgtactggatatgagctccttgagggctgggatagtgtcaggtttggctcatcattgaatccgccacatctaggacggtgcctagtatgtagtaggcactcaataaatgttgttgaaatcatggatgaataaatggatccctgtttctgttagagtgttacctgattcatctctctttcgagaatctcagagcatttcacagttttgtcaaaaatgtactgcagtcaggagaatcgtttgaacctgggaggcagaggttgtagtgaactgagatcgtgccactgcactccagcctaaaaaaaaaaaaaaaaacaaggaaaaggaaatgtcctgcaatcaccttggagaacagaggtcacgctagagtttggaacaaaatattacaaaacgacaaaagctggtttaagagcttcgggaagaggaacctacacatgtgactctaaaatcgtagactgtatctggaaagccttgataagaaagatctccctgatgacacttgatttctggcatcatcaaataaagttgaatagaaatacatcatccagtcttgcacaaaaactccaggacacaaaccaagtaggcaaaggagaaaaacggattacatgagctttgagaggaaaaaagaaattattactgcccatttacttagtcatgttgaataaatcttgagttgttaaataaaacggatcttattctcagttaacccacctggggctccctgagcagttggaaagagatattctatgaagaacccaatcgttcagatactgggaggaatcaaacacctacctaacaaagaagcaaagggatgcccttctgcacttcccacatctttccactgaagtatcccaaagcacaaatgtatgaatgtggtaagcacacaattttgttgaactcacaggtaatattccaaaaatccatgcaaagtttgcttcctgctccataacatatccaaatgcattttaatataaaaataccatttaaaattgctcattgtcgtccaggcaaggtggctcatgcctataaccctagcactttgggaggccaagatgggtgtatcacttaaggtcacgagtttgagaccagcctggccagcatagtgaaaccccatctctactaaaaatacaaaaattagctgggtgtggtggcacgcgcctgtaatcccagctactcatgaggctgaggtgggagaatcacttaaacccaggaggtgaagtttgcagtgagccgagatcacaccactgcactccagcctggggaacagagcgagactctgtctcaaaaaataataataataataataataataacaaaattactcattgtctagtaaaatggaaacccaggaagatgcaccttgttgttttacatacgacccccctttcccagcctgttctcttccccaggcttacgtatctctgtttgagaaacagaccttttatcattggctgaagctgttaaccatattataatatttaaatcagcctggctagatgttgccgccttatacgggaaagatttccaaaggtgatgtcagaagggaatcgaggggctcttttgcaagtgaaaaccaaaatggaatcaatgagaatgagattgccccaaggagatttcagtatttctctaaaaacccttttgctattctgcccctgtggcctaacttgggtgatcactctaaaactttatgcttctggaatccccacccctacagaaatcacccagcctgtttgcacaatagaaacattggccagtggagtataggtcatccaataggattagagaagaggcttctttttctgactacaagagtaatttttattcattgtataacaaattgaaaagtataaaaaggcaggaaaaaaaataagctgatgccccaaatcgccttttggcatattttcttccagcttttttttctgctcttttttttttttagcataatagcgattgtaccacatatataattttttttttggtggggacaagttctcactctgtcacccaggttggagggcagtggcatcatcagggctcactgcagcctcgacctcctgggctcaagcaatcctcttacctcagtctcctgagtagctgggaccacaggcacttgtgaccacacccagcttatttttgtatttttagtggagactgggtttcgccacgttgcccaggctggtcttgaactcttggcctcaagcaatcctcccacctcggcctctgaaagtgctggggttacaggtgtaagccacggcgcctggctgacacaaataaatttttatcttggtattgccacttttaatattatagcatttcccatatccttaaatacttctctaatgattctgtttaaagactattcagtgtcctgatatctagctgtaccataatttactcagccattctcttaatgttagaggtttaagttgtttccagtttttcagttttctattaaatcaataacaccggccaggtgaggtggctcatgcctgtaatcccagcactttgggaggccaaggtgggcggatcacctgaggtcagcagttcaaaaccagcctggccaacatgacgaaaccccgtctctactaaaaacacaaaaaatagctgggcatggtgacatatgactataatcccagctactcaggaggctgaggcaggagacttgcttgaacccgggaggcggaggttgcagtgagccgagattgtgcaactgcactccagcctgggtgacagggtgagactctgtctcaaaaataaataaataaataaataaataacacttgggccgggtgcagtggctcacacctataatcctattactttgggaggccgaggtgggtgaatcacttgaggtcaggagttcaagaccagcctggccaacatggtgaaatcctgtctctactaaaaatacaaaaattagctgggtgtggtggcatgtgcctgtaatctcagctacttgggaggctggagcaggagaatcatttgaacccgggagacggaggctgcactgagccgacattgtgccactgcactccagcctgggtgacagagcaagactccatctcagaaaataaataacacctggatgaacatctttgtgtacaaaattttgcctgcactatagagtgcacacttaggtaaatgtctaagaatgaggactcaaagcatttgcacttttttttagagacagggtcttgctctgtcacccagactggaatgcagtagtatgatctccactcattacaacctctgcctcccaggctcaagtgatcctcctgcctcagcctccagagtagctgggactatagactcgcaccaccacacctagctaattgtctttttaaaaatttttttgtagagacagggtctcgctatgttgcccaggccaatttcaaactcctgggctcaagcaatccaccagccttggcctcctaaagtgggagccaccacgaccagccaatttgcacatttttaagactcttgatacaactgtctattagggtttttagtcacaagtaacagaagctgactctgggaaattgagcagagaagttgtttactaaaggatattgagtctttcacagaattgttggagggactggataatcaaggctaagctgccagaaatgcccccaatcaggccacagaataagctgatggaaaagatactatagcctgtaatcccagcactttgtgaggctgaagctggcagatcacctgaagtcaagagttcgagaccagcctggcgaacgtggtgaaatcccatctctattaaaaatacaaaaaattagctgggcatggtgccaggcacctgtaatcccagctactcgggagactgaggcaggagaattgcttgacccgggaggtggaggttgcagtgagccaagatcgcgccactgcactctggcctgggcgacagataccatagtccatgtaaatggcactccctagatttatacatatgtggtagccctgaaccccactataaaaaaatccactggcactgacgccagcacccaaaatagatggctccctcctttcatcacctctgtcagcacaaaaggaagttctatgcagagcctggtttaatcatcatcctcactgcctaatataagtttcctgaaagcaaagccgagaccacatgcttgcaggctagctgaaaaggacactaagaatacgatgcgagcattataaacttggaattttcacaaatataggaagtaagtttgccagataaaatacaggatgtctggttaaatttgaatttcagataaacaagtaataatttttaatataagtgtatcccaaacaattatgggacgtatagtaaaaaattatttcctgtttatctgaaattcagacttaaacaagcatccatgttcttatttgctaaatctggcaaccctaattgaaatgctattcaaaagattatggtcagctgtgcgggaatatctcaaacatccactacactatcatattgctttagttaaacgaagcaccaaaaatgaacagaagtttctaattcactaatagtctttaaaaaaatgtttgctggcctggtgtggtggctcacgcatgtaatcccagcattttgggaggctgagacaggcagatcccttgaggccaggagtttgagaccagcctgggcaacatggtgaaaccccagtacaaaaattagctgggtgtggtggcaggcacatgtagtcttagctactcgggaggctgagccaggagaatcacttgaacctcggaggcaaaggctgcagtgagttgagattgtgccattgcactcaagcctgggtgacagagagagactgtctcaaaaagaaaaaatatttgctaatttgataggcaaaaactgatatgtaatttttgttttcatttacttttctttgatttttagtgaggctgaacagtttttctaatcctcattatttttatctccctcttggtgaagagatgtttcatgtgatatacattggtctattggagtctttctgttttaattatcaaagacagcattagcccccttacaataaatatactatccctttacctagtttattgtctatcttttaattcatgatcctttttttacagaagttttattttacttttaaatatacatatttatattgtatatatatgtgtgcgtgtgtgtgtgtgtgtgtgtgtgtgtgtgtgtgtgtgtatgacctcctggccaggctgctcttgaactcctgagctcaggtgatctgtttccctcagcctcccaaagtgcgggattacagacatgaaccaccatgccccgcctatttttaaaaaatattttgaatagagatggagcatctcactatgttgcccaggctggtctcaaactcctggtctcaatcagccctcctgcttcagcctcccaaagtgctgaaattacaggcatgagccaccatgcccagccacacaaaggttttgtatggttaagtttcttgcttcccccccatgtttagaacaattttacctagagatcagataaatgtttatttatttcagttttctacgtatgatttgatatttttattttactttttttttttttttttgagacgaagtctcactctgttgcccaagctggagtgcagtggagtgatcttggctcactgcaacctccacctactgggttcaagcaattctcctgcctc[132 bp omitted]ttggcctgctaaagtgctgggattacaggaaagagccaccacgcccagcctttattttactttttaatgtgcatggaggttgggtaatgattaaataggccttatcctaatagttagctaacaaattatcctagtagggtttgttgaacaaaccaagagagatctttttcaaaacacttgtcaacgttgtaagtttctctctttcattacctaatagcactgagcccttacaatttagcatattcctgtgaccctaccaatagtaacagaaatttcatttgaactccatgctatttactcactttatacatttagattcataagcaaagacattcagaagctctctcttagccaggcacagtggcacatgcctgtattcccagcttcttgagaggctgaggtgggagggtagcttgatcccaggagtttgaggctgtaataaggtatgagctattgagaggtgaagccagctggacttcctaggtcgagtggggacttggagaaattttgtctagttagaggattgtaaacacaccaatcagcactctgtaaatacgcaccaataagtgctctgtgtctagctaaaagattgtaaatgcaccagtcagcaccctttgaaaacacaccaatcagcactctgtgtctagctagaggattgtaaatgcaccagtcagcactctgtaaaaacgcaccaatcagcgctctgtgtctagctaaaggattgtaaatgcaccaatcagcactctgtaaaaatgcaccaatcagcgctctgtgtctacctagaggactgtaaatgcaccaatcagcactctgtaaaaacacaccaatcagcactctgtgtctagctaaaggattggaagtgcaccaatcagaactctgtgtctagctaaaggattgtaaatgcaccagtcagcattctgtaaaaacgcaccaatcagcactctgtgtatagctaaaggattgtaagtgcaccaatcagaactctgtgtctagctagaggattgtaaatgcactaatcagcactctgtaaaacacaccaatcagccctctgtgtctagctaaaggattgtaaatgcaccaatcagcattatgtaaaaatgcatcaatcagcactctgtaaaaacgcaccaatcagccctctgtgtctagctaaaggattgtaaatgcaccaatcagcactctgtgtctagctagaggattgtaaatgcaccaatcagcactctgtaaaaatgcatcaatcagcactctgtgtctagctagaggattgtaaatgcatcaatcagcactctgtgtctagctaaaggattgtaaatgcaccaatcagcactctgtaaaaatgcaccaatcagtgctctgtgtctagctaaaggattgtaaatgcaccaatcagcactctgtaaaaatgcaccaatcagcactctggatctagctaaacggttgtaaactcaccaatcagcactctgtaaaatgggccaatcagcgctctgtaaaatggaccaatcagcaggatgtgagtggggacaaacaagggaataaaagctggccacccgagccagcagaaacaacccactcaggtccacttccatgctgtggaagctttgttctttcactctaaatcttgctgctgctcactctttgggtccatgtcacctttaagagctgtaacactcaccatgaaggtccgcaacttccttcttgaagtcagcaagaccaagaacccaccagaaggaaccaactccagacacactatgatcctgtcactgcactcccacctgggaaacagagtgagaccccatctcttaaacacacacacacagacacacaaatctctgtttactcctgagaactatacctaacattcacgtgactcaaatgatgatggggttacatttttgggaacaagatgacctacatctacatagatgtagacaactagatcaaaaaataagaataatttctcccataattttgattttctctaaaccctttattataataaaatattgttgtttttgttgatgattcttgtttttgagacagggtctcactctgccacccaggctggagtgcagtggcatgatcatagctcacagcagccttgaattcctgggctcaagtgatcttgccacctcagcctcccaagtagctgggactacaggtgtacgccaccatgccttgctaattttttaatgttttatagagatggggcctcaccatgttgcctaggctggtctcaaactcctgagctcaagtgaacctcccaccttggcctcccaaagtgctgggattacaggcataagccactgtgcctggcctatatattatttatggataaatgcatatgtaggaaaagtatacaacattgcttttggggtacatagactttaggtagtgataacttctaagggaatagaggacaggattgaggaaaggtgcagagggacttcaaatgtattatgttttatttcttgaaaaactctgaagtccatatgacaaaatacaaagatttgtcaaatctaagcagtgatgaaatcgtttattctctgtagttttctgtgtttttgaaatatttcaaaagttcaaaacattaaaaaaaatcaacacaactaggtgatggatagaacgtgggtgcgaagtcaagaaaggagtcaaagatgactcaggttttatgtctggtgctgacgttagtgacagaaaaagagaagctacggaaactggctttgtggaagaagatgagttatatttcagacaagtgaagctgaaggaaacagcagaacatccctctggaaatgtacatgagactgcgtgaagctggtggtcgggagagaaaacaggcctgccgagagagtggcaaagcaggatattagccctcagccccaccctttcacctcttcacaggggccagccccttcaacattagagtatttcattaagagatccaagaagggctgggcacagtggctcatgcctgtaatcccagcaatttggggggctgaggtgggcagatcacttgaggtcaggagttcaagaccagcttggccaacatggtgaaccgccatacaaaaaaaacaaattagctggggatgatggtgcgcacctgtaattggaaggctgaggcaggagaatcccttgaaccagggaggccaggtgagactccatctcaaaagagatccaagaaggaggggaggaggaacaatgaagaagtcaggtaatgaggaccaaggaaaggttactgagtatggtgatgactttcagatgagaagattttttgttgttgtttagagacagggtctcactctgtcaccgaggctggagtgcagtgcctccattatagctcactgcagcctcaatgtcttgggctcaaaggatccttccacctcagcctcctgaatggctgggactacaggtgcacactgccacgcccagctaattttttttcaatttttataattttcttaaaattatgttttgtagacacatgatcttgctatgtagccagggctggtctgtaattcctgggctcaggcaatcctccaacctcagccttccaaagtgctaggattacaggcatgacccaacgcatctgacttcagatgagaagatttttgtcaagcagttatgagaggccaagtggcaggcagcgaaggatcaagtgagtagcaaaaggaggggaagcagtggtagaatattcattttacaagacaaacaatgaaagggaagggagctactatacagcatttatgaataaatatacagatagtaagagtgtaaaaactagcaatgggaagtacagacactgacttcatatgtgaatgtacatgcatgtatgtgtatacacatacatgcacatttgcacacatgcatgtatgtatgaaatgtatatttaggctgagtgctgtggctcacacctgtaatcccaacaccttaggaggttgaggcaggcagatcacttcagcccagaagtttgagaccaacctgcacaacatgttgaaaccccatcactacaaaatttaaaaaaaaaaatagctgggcatggtggcatgcagctgtagtcccagctactcaggaggctatgggaggatggcttgagcttgggaggttgaggttgcagtgagctgagatcaccccactgcgctccatcttgggcaacaaagtgagaccctgtctcaaaaaaaatgtataatggaacatattttattcattcacaaacactaattaataaacttcaaaatctgtcacagtgagcaaatatatatatatatgcacaaatatgatgtatacttaatgatagatatgtatattatgtctgtgtacacttttaccttgtgtgaagagggtaccaggaaagaactaagcatttaggatgatctccacctcagagtttttaaatggacttccattcatgagtgcggaaaatgaacatctcagaaagcttctcgcctggagtactgtgagggggaaagaagtcaaaaatatacccactctggagacattttcagccatttcaagagaaagatgaaaccaaagtcaatagctcttaaggataagatgcaaaaaaataaatcctttaagagggaaacattaaaaattgctccctaactactagcgtaaaagcaatgcaatggcaaactccttgaggtggagatctttttttttgcatgcacaagtcagggaaagagcaaacgatgacgtgaagtcactgagctggaggaagtccagaaaatgaagtaaagaactgagaagatgaaatagtttccacagaataatacactaaggagcatttcccacatgtatttgaccaaggaacactcttaaaattatcgtatgtgactggaattccaccaggaactcaagatataatgctcatttgaatgaaagtagacaaccagggctgggcgccgtggctcatgcctgtatccccaccactttgggaggccaaggtgggtggattgcttgagcctaggagttcaagaccagcctgggcaacatagggaggcccccctccgaccaccaccatagctgggcgtggtgactcatgcctataatcccagcactttgggatgctgaggcgggtgaatcacctgaggtcaggagttcgagaccagcctggccaacacggtgaaactacaaaatggtgaaactactgaaaatacaaaatgtagatgggcgtggtggcaggcatctgtagtcccagctactcgggaggctgaggcaggagaatcacttgaacccgggaggcggatctttttatgttttgttataaaatgtggcatatatgaagcaatgttgaaaaatcatttgtcttttctttacatactttcttaatattatgaacaatcgtcctgaatgaaaatgttatataatgtagccattcaacaaatatttactgagtgcctactatatgccaaacactgttctaggtgctgtggatatatagtgatgaacaaaacacacaaaaagctttgctcatacagagcttataatttatggggagagacaaatactaaatatatataggttggctgggcgcagtggctcacacctgtaatcccagcaatttgggaggccgagacgggcggatcacctgaggtcaggagttcaagaccagcatgaccaacatggagaaaccccgtctctactaaaaatacaaaattagcggggcatggtggcacatgcctataatcccagctactcgggaggctgaggcaggagaatcgcttgaacctgggaggcagagtttgcggtgagctgagacgacaccattgcactccagcctgggcagcaagagaggaacaccatctcaaaaaaaaaaaaaaaaaaagatgtgtgtgtagtaaatgctatggagaaaaaacaaaacagggaagagaaaaaaataggtagtctggggggtgggttgcaattttaaataaggtgtaaagggaaggcctcactgagaaggtggcatttgagcaaaggctggaaggaggggagaaagagaaccactcttctgtctggggtaacagcattccagacagaggggacagcaagtgcaaatgccttggggctgaagcatgcctggcgtgtttgagaaagagcaaggaagctggtaagcctgatgtgagtgagcaaggggagaatggagaggagagtggagaggtcaccggaggtgagggcgtggaaccattgtaaggacttcagcttttgcgaagtgaaatgatgagccagaggaaagttcagagcagactgctgtgatctgacttccattttaacaggatcactctggctgctgtgttttaaacactgaatgggccaaggctgtaagcaaggagaccatttaggaggctagtacattcttagagacgatccatcatcttagtaagagatgatagtgctttggaccagggtattaatggaagtggtgagaagtggtcttatattttgaaggtagggacaccaggatgtgctgaaggattggatgcaggatgtgagagaaagaggagtctgggatggctccaaggttttgggcctgagcaacctgaaaaatggagttgtcattaattgagatgtgtaagcctctgaaaggtttcttgggggaagatgagtagctgcgtttgggacatactctctctctctctctctctctctatatatatatatatatgtgtgtgtgtgtgtgtgtgtgtgtgtgtgtataaaaatatatattatatcacaaacacacatatataatatattatattataattttatatataattttatatataatatatatgtatttgagacagtctcacttcgtcacccaggctggagtgcagtggagcgatctcagctcactgcaacctccacctccccggttcaagctattctcgtgcctcagcctctggaatagctgggattagaagcacgggccaccatgcccggctaattgtttttgtatttttagtagagacgtgattttgccatgttgcccaggctgttctcaaactcctgccctcaagtgatctggccacctcagcctcccgaagtgctgggattgcaggcgtgagccaccacgcctggccctggacataaattttagatgactataataaatgcaggtggggatgttgagtagacagttggatgaatgagtctgcagttcagaggagagatctaggttggaaaagtaaatctggaccttgtcagcgtatagatacctactatctgatacagtagccaccagccacatgtgacgattgatcacctgaaatgtggctagtccgaaatgagatatgctatgagtgtaaaatactcactggatgtcaaagacaatacagaaaaaagaaagtgaaatattttattaataatttttaaatattgatcacatgttgaaaagatatttttggctatattggattaaataaaatacattattaaaattgatttcatgtgttcctttttacttgttgaacgtggctagtaaagtatttaaagttatatatgtggctcacattatatttccattggaccgtgctggtacagatgttatataaagccataaacactggatgagatcatcaagggagtgagaagagtggctagagaagaagtctgaaaattgaggcctcattgacaagaaatatattatatatatataaatatatatacacaccacatacacatatataaacacatatatacacacatacacattcaactttattgagttttaattgtaaaaaataacgcgccttcattttatatatgtatatatgtgtgtatatatattcacatgtatatatatgtatatattcatgttaccaccaccccaccatattttgttttagttgcagcttaaaatgaataaaccattttgaatagattcattggagcaaaaagaggaacacaaatcccctgttttacaatatttaggcactctttaattcatctgtttcagaaatcattattatttcattctagacacctcacctcctgagtttttagaaatcaaaggctctcattgtttacattttctttaaattattctaactctgtctttgttagattcagacacagtttgagccccataatagtggtttttgtttataacttttcttt[150 bp omitted]gggcttggtggcgggcgcctgtagtcccagcttctcgggaggctgaggca[137 bp omitted]tttcgcccaggctggagtgcagtggtgcgatcatagctcactgcagcctccaactcctgtgctcaagcgttcctcccacctcagcctcacaagtaactggggctacaggtgcacaccaccacacctgacttataactattctttcaaccagacatctctggggaatgaaaagaatgagtttatatagcacagggccacttgtatagggttcaacagactgtctctacacaatttttttttttttgagatagagtttcgctcttgttgcccaggctgaagtgcaatggcattatctcggctcaccgcaacctccgcctcccgggttcaagtgattctcctgcctcagcctccggagtagctgggattacaggtgcccgccactacacctgactaatttttggtatttttaatagagatgggttttcaccatgttggccaggctggtctcaaactcctgacctcaggtgatccacccacctcggcctttcaaagcgctgggattacaggcatgagccaccgctcccggcctctatacatctttatacatctccaggggagtgccattcacatagtctatgatgtgattggcatctccagaattgttcaatgtggcaacacttaccaacacaacatcatactgagatatattgtcctccccagtgatagcagtttccgtgacattattcagaattacgtactaaacacatgtaccaccagggctgcattgattttctattatgttttcattctcctggtgatcttttatagactttcagtagtctttggccatggtacacccatggtacaccattttaaaaggcagataatcacataataattataggaatgtattctcaaactcctgacctcaggtgatccacctgcctcagcctcccaaagtgctgggattataggagtgagccaccgcacccggcctacacccatctaattttttttttttttttttgtagagacggggtcgccctatgttgcccaggctggtctcgaactcctgggctcaagcgatcttcccaccttggtcacccaaagtgccaggattacaggcttcagccacaccctgcacagtcttttttctttctttctttctttgagacaggatctcactctgtcacccaggctaaagtatagtgatgcgatcatagctcactgcagcctctacctcctgggctcaagtgatcctcccacctcagcttcccaagtaggtgggactacaggcactcaccaccttacctatctaatttttttatttttattttttgtgcagaagggggtctctgtatgttgtccaggctggtattgtattttttaaattgagctggaatttgcacaacatacagttcaccatttaaaagtgcacaattcaatggcatttcgtgcattaaaaatgcagtgcaaccactacctctctctagtttcaaatgttttcatcaccccagaagaataccttgtacctattaagtaattactctttatttccccctcttcctgacccctggcaaccactaatatgctttctgtctctataaatttgcctattctgggcattttacaagaaaggaatcatacagtatgtgactttttgtctctggctcttttcatttagcattttttagacgttcattcaagttgtagcatgtatcagtcatgcattccaatttatggctgaataatatttcaaaatatagatgtaccacaatttatttatccactcatccattggtggacatttgggctgttcccatcttttggctattatgaataatcctgctgtaaatatttacatacaagtttctgtgcagacatatgttttcatttctcttggaaatatacctaggagtgaagttgctaaatcatatggtaattctatacttaacattccgaggaactgccaaactgtattccacagcagctgcaccatttcacattcccaccagtaatatacaagggttcccatttctgtgcatctgaccaacacttgttattttctctgtgtgtgtgtgtctctgtgtgtgtgtgtgtctctctctctgtgtgtgtgtgtgtgtgtgtgtattatagccatcctagtggatgtgaagtggtatctcatggttttgatttc[131 bp omitted]acctccacctcccaggttcaagtgattctccttcctcaggctcccaagtagctgggactacaggcgcgtgccaccacgcccggctaatttttgtatttttagtagagacgggatttcgccatgttggtcaggctggtctcgagctcctggcctcaagtgatctgtctgcctcgacctcccaaagggctgggattacagacgtgagccactgcacccggcctagcattttttcatgtgcctattggtcatttgtatatctcctctggagaaatgcctgttcaagtcctccacccatgtttttgttttgttttgttttgttttgttttctttgagacggagtcccgctctgtcgccaggctggagtgcagtggcacgatctcagctcactgcagtctctgcctcccaggttcaagcgattcttctgcctcagcctaccgagtagctgggactacaggtgcgcaccaccacgcccagctaagttttgtattgttagtagagacaggatttcaccatgttggccaggatggtctcgatctcttgacttcgtgatctacccgcctcagcctcccaaagtgctgggattacaggcatgagtcaccatacccggcctttcttttcttttctttttttgagagagggtctcactctgtcacccaggctggagtacaatggcgtaatcatagtttactgtggcctcgacctaccagactcaaacgattctttcaccttagcctcctgaatagctgctctacccatttttaaattagattgttggcccttttcgtactgaattgtaagagttctttacatattctgaatactagaccctcaacagaattatgtttcccattctgcaggttgacttctcactttctttataatgtcctttgatgtacaaaagttttaaattttgatgaagtccagtttacctatttttttttcttttggtgcttgtgcttttggtatcaaatttaataattcattgccaaatccgaggtcataaagatatatctctatgttttcctctaagagttttatcatttcaaatgatatatttatttatttatttatttaatttattttttttgagacagagtcttgctctgtcacccaggctggagtgcagtggcataatctcggcccactgaaacctctgcctcctgggctcaattgattctcctgcctcagcctcctgagtagctggaaacacaggtgcctaccaccacacatggataattttttgtatttttggtagagatggggtttc[133 bp omitted]tttcatttagtttttgtatatggagtgaaatagggatccaactttattattttgcaggtgattttccagttatcccagcaccatttggtggggaagagatgcttatttcccccattgtatggtcttgacactttccgtagtattttaaagcaaatcctggacatcatgttgtttcatctgtaaatacttcagtgttgatctcaaatcgataaagacttcatttatttattttgagacagggtctcactctgtcacccaggctggagtgcagtagcacaatcatggctcactgcagcctcaacctcccaggctcaagcaatcctctcacctcagcctcctgagtagctgagaccacaggcatgcaccaccatgcccggctaatttttgcattttttgtagagacagagtctcgctatgttgccaagctggtcctgaactcttgtcctcaagggatcctcctgctttggcctctcaaagcgctgggattacaggtgtgagccaccacacctggtcagttccatttcttttttcttttttttttttgagacagaatctagctctgatgcccagactggagtgcagtggcatgacctcagctcactgtaacctccaccttgctggttcaagccattctcgtgcctcagcctcccaagtaactgggattacaggcatgtgccaccaggcctggctaatttttgtatttttagtagggacggggttttgccatattggcctgtctggtctcgaactcctgacctcaagtgatccacccaccttggcctcccaaaataataggattacaggcgtgagccaccgcacacgggaagctccatctcttaagtggtttgctttcctttgtctgaattaatcctggtcttgccttctgtacaaagaagcagtttgaactaaaatttagtcactaggcaatttcttttcttttttctttcttttttttttttttttgagacagagtctggctctgtcacccaggctggagtgcaatggcatgatctcggctcactgcaacctccacttcctgggttcaagtaattctcctgcctc[134 bp omitted]acctcccaaagtgctgggattacaggcgtgaaccacagcacccgatctcactaggcaatttctaaggtctgatccaactccacgtacctgccctccctgtccttgctcctgttctgatcctagtccctgtaattttctggatacaacttatctgtccctaaaggctcctgaaagtccttctttgctcttttcagttgtgcccaggaataatttccactggacttgtccagcaccaagtcctcatatcctttccccagcctggaccatttgttgtctctctctctttttttttttttttttcatatgaaggcgacactaaaccatttggtctctttataagtaagtttcgcagtcagcagtctgggcaatagtgtgagatctcatctctaaaaaaaaccttgaaaattagccaggcatggcatgtacctgtagtccaagctactcaggaggctgaagcggaggaattgcttcagcccaggagttcaaggtaaaaaaaaagtttcatattcaggaatatacatgtacataatagaaagcaatacctaatgctttctacaacatttgaaatacttaagaagcttacactggcattttcacagacatatcattagcttcctgcaagggaaagggtcattttgaaaaccacaacattttatggatgaagaggttttctcttttttttttttttttttgagaggcagtctccctctgtagcccaggctggagtgcagtggtgtgatctcggctcactgcaacctctgcctcccagttcaagcaatcctcctgcctcagcctccctagtagctgggactacaggcacccaccaccacacccaactaatttttgtatttttagtagagacgagattttgccatgctggc[131 bp omitted]gacaacacgctaaatttggacttatcccaaactcccactttcccagtctgacaagtttggggactgccctctccaacccttctgacttagtctcccaggcatgctggctatctggctatagtctagaattgactcagcaaacaagcaaatgtaaatactcactgaatctttctggggccattccgtggaaacagaaatatatttaagtttttctgcctttgagaaactgctacggggcatagccgtgggtagatatatttggtggctcttagaccccctgacatacacccacggaccatcctcatctatttgctttctggcttctgatctgggcccttcttgggaatagtttttctctgaccctagagtctagactaaagccaattggacattcacttcctggtttttttttcccatttgtctggcagtttctgtcctggcctccccatacttgggctctcctatcttggattcataattatatttctagccactttttctttcttactcctttagctcttattttctttttttttttttttacagttatatttgtataattttgagaaggacaaatgcagttttgttacgtggctacattgcatagtggtgatgtttaggcttttagtgtatccatcacccaaatagtgtacattttacccattaagtaatttcttatccctcacccctcttccacccttccacccttctgtgtctccagtgattattccacattctatgtccatgtgaatgcattatttagctcccacttataagtgagaacatgcagtatttgactttttgtttctgagttgtttcacttaatggcctccaggtccattcattttgctgcaaaattcataattccattctttttatggctgaataatattccattgtgtatatatatcacatttcctttatccaatcattcattgatggacacttagtttgattccgtaactttactattatgaatagtgctgtgataaacgtgagtataggtgtcttttggctataattatttcttttcctttgggtagtttcccagtgggattgctggatcaaatatagttttattgttaattctttgaggcctttcattacggtggggtttttttgttctccctttcccctcaagtagcctctgaacattacatgcctaatcatcctctccctggctcagctgatggtcctagcatctcccactgatgggctttttcttattctcctgaagagtttcatatggcttcacaagataaaattgcattttgattatggttctcatagatttctgctttgcaaaaaaacaaacagacaaaaaccccacaactcaggaaaccacgctgatatattttttaaaagtctggttctgactatttttctattctccattggcttttactattcaaaaccccttgcctaccagcagtagcattacacctatccccacctctcttagctgtggggctaaaggatagaacattctatttggctaaagaaaaaagtaggacattctatttggctaaagaaaaaaggtaatcagactgagcccagagatgtacacataggggctcataaacaaaacaacctcgtttcactcttttacagcagaattttagctaggtcacttctactaacagccatctattgggggaaaattaatgactatcaatttacaaaacaggattatggaaaacttttaaatgagagctagatagagaaactcttgggttaacgctcctcagtgacctagaagtatattgaaaaaacaaaatagtgcatttctgataatgaaacatgacaaccgtacctaacctttttaaattaacagtggtgcatatatactgtgatcttttcaagggcagcaggaccacatttgaatcattttctccataggttatcttgaggaacatgatagtcaaatgtccctaggcatctccacccatctgggctttgggtcatgaattgatacttatacaggaactagctgccattaggtggagcaatttgaagtctaataggccatctagaaggatatcagatcaggaggtttaagaactccagatgttttaatttaggtgagtgcagccacaaggctgctaggacattaacaaagaactgattgatagagaagaaaaagtagctggtattagataatggtattagataaaagtagctggtattagatgatgggaggggcctgatgtctggttgccaaggcacctaactcttcactcgatagtcccccaagcacaggattcatggcttttgtggccccatcccttgggcgtagagcataatccttagctgacctttgaaaaatgcaacctcaggcttgcccggcttctggtacttccaactcttctttgccattattataaacacaattatcagtctttgaggggaggctgatcttttagttcagatttccagagttcagattggcaggtgtcctttgtcatctcataaaggaattaaagtgacctgagaaaatgtcctctgggtaagatcaatgccacctgtactctgtccttgcccaaactctttcatcagagctctcatgtgcatcagcccttccccactcccttcaagcctgtacagcctgggcatgacaacaaatttggtcctttagcaatagcatgtacaactaatggacaactcccaggttatcatctatcccttttgagaactcaataggattattattattattattattattttgagacggagtttcactcttgtcacccagctggagtgcaatggcatgacctcggctcactgaaacctctgcctctaggctcaagtgattctcctgcccagcctcccgagtagctgggattacaggcttctgccaccacgcctggctaatttttgtatttttagtaaagaaggggtttcaccatgttagccaggctggtcttcaactcctgacctcaggtgatccacctgccttggcctctcaaagtgctgggagtataagtgtgagccactgtgcccagatgagtattacatatatatatatattttttacttctttttattttttattgttattattttttagaggcggagtctcaccctgtcgcccaggctggagtgcagtggcgtgatctcggctcactgcaagctctgcctcccaggttcacgccattctcctgcctcagcctcccgagtaactgggactacaagtgcccgccaccgcgcccag[138 bp omitted]cccggcctaaaaaatatttttaagaaaatttaaaaatatttttaaaatatgtttttaatattatttttaaaatattcctttgaaggataaaaaagtgaaaaagaaggtgttaactttgggaaataaggaacctctcattattccaagtggtaccataggcgattaatatatattcaataagttttatattatttaaaatatcttataattgcgatagggcttttaactttttcaaatactcatatattgcctatattattgtatgcaacaatatacagttgtttgacagataaaatatatatgacaatctcactataaattcatgactaatggatccgcatagaattagagtaagatggagagtctcccaaggcccttaaggttagtcagtgccatgtggtgtatctgaaagagacctaaaagacctggcttctgtttctggccctgccaactactgtgtgacttatctgtaaaatggggaaaaataatcttggctctgtctacctctccagattgttctgaagattgaatgagataatggatataaatatgctttggagaccatacaactctccacaattatagtttggttgtaataaatgcctcaacaacacacagaagtgaacatggtatcatgatttcttttgttttgctttatttatctcattgaagtcatcatgaatatattctgattggaaaagcagcacacaatttgtatataataattaattattgagtgacctttaagtgctgggcactgttctaggcctgccttgtgcaacgttgtggccactagccacatagagctattgagcacatgaatgtagttcatgcgactggggaaatgaatttgtaattttatttaattttagttaatttacacttaaatacaaaaactgatatgaaataattattagaattgtttttctgacagggtcttgctctgtcacccatgctggagtgcagtggcacaatcacggctcactgaagcctcaaactcctgggctcatgtaatccacctgtctcaacctcctgagtagctgggactacagacgtgtaccacaatgcccagctaattttttaatttttaatttttttgtacagatgggatcttcttatgttgaccaggctggttttatttatttctttatttatttagagatggagtctcactctgttgcccaggctggactgcagtggcatgatcatggctcactgcaacctctgcctcccggtttcaagtgattcttctgcctcagcctcctgaatagctgggagtacaggtgcgtgccaccacgcccgactaatttttgtatttttagtagagatggggtttcaccatattggccaggctgttctcgaactcctgacctcgtgatccacccacctcagcctcccaaagtgctgggattagatgcgtgagccaccacatctggccaatttttttgtaattttagtggagacaaggtttcaccatgttggtcaggctggtctcaaactcctgacctcaaatgatcctcctgcctcagcctcccaaagtgctgggattatagtcatgagccactgcacctggccattagaaaactttttttttttttttttgagacggagtttcgctcttgttgctcaggctggtgtgcaatggcgtgatctcggctcactgtaacctccccctcctgagttcaagcagttctcctgtctcagcctcctgagtagctgggattacaggcgcccgccactacacctggctaagttttggcatttttagtagggatagggtttca[131 bp omitted]gcttctttttactaattttttaatgtggctacaagtgaatttataattacatatgtactcatattatatttctgttgggcagtgctgctttaggcactgatgataaagcagtgaacaaaggagacaaaatatcccgctttcatggaacgtgcattttagtgcggaagacagatgataaaataaatatataaacatatatagtatatcaaatggtgacaagtgctttggagaaaaacaaagaaagcaagttagataggagatggtaggagggttgaacttttaaatacgaaggtcaaggaacgcccaaaatctagatgttgagagagtaagtaatgaagcttcttccgctgggtagaagcaacagtaagtgaggaggccttgatgatggacaaagccttggcaattcagggaccctcaaggaggcctgtgtggtagatcatggagtgcaaaggagaggatcaataggagatgagatcagacaggtatgggaaaaaagctgtaatgctatagtgagacaggtcaggtagattgtgatgggcagcttctgacatggctccagatgattcttgcctcctagtattaatgccctgtgttaatatcttccccttcaatgtgagctggacctagtgaataaaatacagtaaaattgatgggatgccacttccaagtttaggttataaaagactgtggattccaattgcaggtagtctttcactctttcaactctctcttgtttgctcacttttttttctttttcttttcttttcttttctttctttctttctttttttttgacagaatctcactctgttgcccaggctggaatgcagtggtgggatcttggctcactgcaacctccacctcctgggttcaagtgatcctctcacctcagcctcctgagtagctgggattacaggtatgcaccaccacaccctgccaactttagtattcttagtagagacagggtttcaccatgttggccaggctggtcttgaactcctgacgtcaagtgatccacccacattggcctcccaaaatgctggaactacaggcgtgagccactgcgcctggccctgtttgctcactttggtaaactgccatgttattaactgccttctggagaagctcatgaggcaaggaactgaggccaacctctggctgacagccagcaaggaactaaggcccttactacaacaacctgtgaggatctggatgctgccacaaccagtgaatgggcttaaaaacaaattctgccccagttaaaccttgagatgggtgaggcccctgctctgacaccttgatcatagcctatgagagatcctgaactcataccttgatggcagcctagcgagagactctggtctggacaacccaactaagccatgcttagattcctgaacgacagaaaccgtgagataatacatgtgtattgttttaagctgctaaacttgggggtaatttgttacacagcaagagataacactagatattgtaggtcactgtaagtagaaactgaatagggggttggtgggactcactggctatgttgcaaatagactacaggagggtaagggtgaaagcagggaggtcagttgagaggctattgacataagcttggtaagggttgctggtggtattggtagagatattaagaagtggttggatttcagacgtattttgaaggcagagccaacaggctttgctgttggttggataaagggtgtgtaggtaataagatgactctaaggcttttgttctgaggaactagaaagaatgatcatatactgagatggagaaaactatagaaaaactagattcgtggagaaagaataagagttcgattttaggcacgcttaattagagatactagacatcccagtggggatgctgagttcgatatacaagtttgatgtttgaggctggaaataaaaatttgagagtctttagcatttagatgataaaatgttaaagtctccttgctccccacttccactccccacccatgaggcccccactattagctcatgtatagggacatacatatacacacacaccacacacacaaatttttctttttttgagacagaatcccgctgtatcctccaggctggagtgcagtgaagcgatcttggctcactgcaatctccacctctcgggttcaagccattctcatgcctcagcctcccaagtagctgagattacagggtgcacaccatcacgcctgggtaatttttgtatttttagtagagacggagtttcgccatgccatgttggtcaggttggtctcaaactcctggccaggttggtctcaaactcctggcctcaggtgatccgcctgcctcagcctcccaaaatgttgggattacaggcgtgagccaccgcgcctggcccacacatacacattttcataaatagagttgttctgcaacttgcttttatcagtgaatatcctttggagctttttcaatgtaattacatacatatttacctcattctttttttaatagctgaagagagtcccttcatttgaataaatcatgtgtattcattcattcgctgaacaactattttttgagcactcacaatgtgccaggcagtggtctagggactgatcataaagaagtcccttttagatggacattcaggttctttctaatattttgctattacaaacatttgatataatgaccatccttatacaggcatctgagctcacatatgcaagtttttatttggcattgatttatacaagtggaatttctcagtcaaagggctcaatggcatttctaatacttgtatctcaggttcaattaggatagaattaggatagtgttaatgcagcagctaaatttgtgataaaaactgaatatatttaacgaatgtggaaaagaaatcgcccaataaaatgccctattggaagttgtaagattgcacctacgatttctctttactatgtgagtgcagttatatccaaatcctacccattccgcaaagtccagctcaaatgctcaaacaccccctgttccagaaaacctttcatagacctaagaagatatgatctctcctgccttttttttttcttttttcttttttgagatggagtctcactcttcttgcccaggctggagggcaatggtgcaatcttggctcagtgaaatctctgcctcccgggttcaagtgatctcctgcctcagcctcccaagtagttgggattacaggtgcctgccaccatacctggctaatttttgtatttttagtagagacggattttg[132 bp omitted]gtatcacatactactttgtaccataaatacattctctactagactttcttttttttttcccagaaggaaatagtgtctttaattcatactgcattctccctcagtgtgtagcaccatgctcaatgtttatgtatttaaatagaagtcttaaaccagaagaagtgaaatctacaatctcaagaatgagcatagagcctgcacaatggccagatggtgtttgtgcaccatcagtgtgacatatgcttcccatggctcacaatactctgcagaaattgcttacttctcctactctatcttgtaccactcttcttccttctacgctccagccacactggcctttttttggtctttgaacacactaagtctgcccccatctctaggccttcgttcctggcatttctgtcgcctggaatggtctacctgctgatctctgctgactgcttctttaagactcagctcagtgtttacctcctcaaagaagcttttcttgatcatctattttaaactaggtccccaactccagttactctctatcaactccccttaattctctacatagcatttatgtttctgaaattaacatgttcatttctttgcactgacatgtgagctccaggagaggagggaccttgcctgtcttgttcaatgctgtgcaccttcagtggctaccatagagcctgtggtactaagaatgcttttggctgaaagtaacagaatattcatctaaacgtgtcataaactgcaggggtttatttttcttacataaaaaggaactagaggtaggcagtatcaggcctggttcaacagttcaatgctgtctggattctacattggcttctctgagattgccttggccttgcctcatggttgcaatatggctgccaagggccaaagcattgcaagaaaacatccctctcaggaagaaagtggggcctgggcctctctcctttttttttcatcaaggtagaaaaactttcccaggaaccctcctctcacacttccctcttatatcttattggcccaaaccgattgggagtctagaccatcccactagtcaataagagggagcttatcatggttttttcatcagtcatgattcatcacctggagttgggcctgccttccttaaaccctgtggctctgccctatatctgaagtaaatctgggctctctttgcaagcaaaaagtgttatagctattgtggtggtaaccaacagcatgagccacacaggcatttatggaacagagggtatgaattcttggagatcagcctacacgcaacaattaacaaattttacacgtactgtgcaaaactaagatttgtgacagaatgtctttagaggacttccaggtcccaggccctctaggagcctccatatatgctttattgagactgatgggatggctgaaataggcttactgcgaagagacttggccttttctgggttcaaagaaaccatcaccacgcatgcccttgtttccataataaagtcccctaaaagactgtttggtctttgagggtggggaaagtgcccgatgggtggtggtaggactgctttcagaagggctgctcggtcccccagactgagggccattttcaaactctcaacaaatgaaataaccagatagaaaactgccaccatcagtggagcctttcactctgcacttcaggaggtctgacagggtcactagtacttcaagattcccgtccctatttctgtcttaagcatgttcgttttataccctgttatgagatgttctttgattcttggaaaaacaatttcttggaagctgaaaagagtaaggagatgaataggaaatggagaggtgagtgcagggcacttgtaaaagctactataagattggtaagtccaccaaacccagggagatggccttcctaatgcccacccccaccccactcctggtgcagtcagtgctgacctagggatcacctgccacaggctcatcctaatgcccacccccaccccactcctggtgcagtcagtgctgacctagggatcacctgccacaggctcaggctccaccacccagctctcccccgtgggggacggagcgaggggtgccgccacaataagttcccacttccagaagcatgctctctccccagtgttgccccctgttaggtgagccaactgagtaggaaaacggtgtgggcgaggagggggacccagtcgagccgctcacgctggaaagcagctctctgtccttcgacattggtgcgacccttccccaaggagcacacaaaaggcggctgctccacgttgttttccagcccctagccgcctgggccctgggggcttgcggggtggagggacgtgagagttctccagccctcctgcgggcactgcagctcggaggcgggagaggagcactagggcgggagaggagcacgccccactcttggagacatttcatcacccctctctgttcccccaccccaccccgccctccccactcaagcggaaaaaaagaagcagcccagatctcccctcccggatgcggctgcaccagcaacatcagctgcgggcggagcccgagcggtagccacttcccccctcttccctcgtgaccctcgcccccacctccagttctccctccccctctacacacccttccccatcagacacaccctcctgcttcggctggtggcgatcggagctcgggccctctaggggagggagctgccgccgccgacgccgtggggcaggacagtgagcgggcgaagcgagcgagaaaaggagggaaggagggaacgagggaggagcagcgggtgggaggtgggagggaggagcagcgtgagccgcgccgccgccgagctgcgatgtggccggccggccggcgagtaaacagagggagcagcagcggccgcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggtgagtggccgggggacggggcatcccgggggacgcgctccaggcgggagcgacgcgggaaggggcaggaacggcgccagtgcggccgcttggtgcgccgcgcgctgtctttctccgctccagtaagttttcgcaccggcagccgccggccggggtccgagtcccaggcgccggctgacagctctccggccgcccggcacggcggaggcgtgcgccgggatggaagcagacgggcaaaagccgggctcggacggctgcggaggaggcggaggcggaggctcccacccagggtcggggccgggggtgtgagctaaagagctgacctcgcgctgctctggactcggcacaaagagccggggacaagggcacgacgagatcctgatcccctcccgcgagcacctgaggccgcctaggcggaaggatgcgatgagcgtttggcacacacactctcgcgcgcacacatacacacactgtgtacacaaaaaagaaccccacccagaaagccccgggcgcccaagctcgggctggcggtgagaacagaggaagcagagcgacttcctcctgcaactggggagagagggtggtgatgggtgttgaaggggtgctgctgcggaggaagggcattagaaacaacggggttctgcgacagagtgggcgcagggtcatccaccgcagggagagtgtgtccctcggggacacgcgagcgctccagaggcaaggggaccaaggggacggtgccgtggggatttgggggaagactgggtgtgtcagtccagggatggaggacctggggtcagagccccacagctcaggactgggggatggggattcgaaagcgcgctgactccctgggaaccctcccagagcaccctcagccttatccagattgtctgactctggagaaaggctaaagggtgctaacgggcacttgccccttctcttgttttcaagacactcgttgccagtttcctggacaagcgaacaaaccctgaataagcaatcggactgattaattagtgtttgttttgttactttgttttttggttgttgtttttgtttgtttttgtctccctcagctccattttacagcgagtcgtttgctgtgtttaaatttcaccgtttaagagagggctctttttgttaaaacaacttgtcatcggaagggaacttcacagcttttccttgtaatttttctgttgatcttgtagaatcagcaataaaacccagcattaaagggaggccaggggcttgatcccaacagtggagaaagttgacattagtgggagttctggaggaggatcaaaggtaaactatgtacctttgagataaagatctgatccctaatagctacaactgtgcaaacctaagtgactttaaagaaatctctttattgtggctagacccttgaaagtttaattctgctgtttagtggagctaaatccagacctttaatgttactttaatggacttggcttgtgtatttcagtctgattttggagtgaggacctgttgaggtcagattggagccttgcctgtcatcacagccagttaagagaggaaggcaagctgtgtgcagagcatttataccagggctctcatcttgggtgattgttaacacgtgattcaatctacctagcagagaacgctttcctaaattcagagaaaacaaaaaaccttccttgagcggggttggctggccttctaccacaacacgtgaagaaagctgtaggtggccagatttctcgagaataaatgggactaagaaaacttccactgggatttgatcagcacttgacctgccaccctagcagcaaaaagttaacattagcattctttcccctgtttttaggttttcaaaagaattttgtgcattgtaggttcagcggctccttcctgaccattgattctatggcgaaggaggaaaaactgttattggcaggagtcttttctaggagacgctggcagtggccatggttcccttgtcagcccagcttacttgggaccaaggtcattgatttttaccgtttacaccaggcaatgcagaggaatatttactcattactctagtatgtgaaccacattgagattttgggagtgagggagaacagattctagtaatctaaatcaatgaatatctattgagcccttacaatgtgccacacacaatgctagatgctctataattatgagaatgcaaatgatctttttcttcatttgttttcattatttacaatctgggttggttgtgtgtatgggaatgtctttgtcaataggacacccagattatgcacacaaatcaagtttagattcttcatagagccttagcaaatgctatttgtaagcagtttagtcaacgaaaaaataaggaaatagttcttacatggaatgtatgctcctaaatgactctctctcacaaagagctgttaaccaaagttagtaaaaccacgagtggctggagagtgaggggaccatgttgcagctgctgccataacttctgattcttttaagggacagctgaggtaggatttacacttgtgctataaacccaagatactcacattggggcttcaatatgagttagagccattaccgcagcaagtcaagctttcctctggtgtatctcttgttagaacatggaaaacccaccaagctgtacaaatatacagtatttcctgtttaggttttttttttattttttttttaaggattttggaattacacccttgttggcctgttgctaacatcattcagttttcctcactgtttgaaaaattcagatggctgggcctgggctatatatagcatgttgttgcgtattcaaactgttattcagttattagtacttccacgaatctattaactaactacataataaagcagacagagagactgttccactgttactgcattttcctataagttcagcatttttatgaaggtcagttttaacccagggaaagggataattacagaatcatcattgacagatttctcaagaggggattggggagaaacattataacctgagagtgtatgtgattaagagagaagtgtttacatatgtacttgtttaaaatgcagagttttaaatttttaaattgattttgttgtaattcaggatgtagctactggtgccgcaggggaacaaaggcattttgctaaacctgttgtattatggccgccctttagagaagccactttatcagcctggaagagtcgcctagtagctgtttaaatactgtttactgcggagcttaccctcaattccttgtgcgccaaaagatcgggaaagagttgctagatattaggggttgtagcccctggacgcgccgtaatgcacgcagcgtcccctggctggcatcagccagatttcgtataatagctccagtagagaaaagctctccagaagctgagaatggctgaaaagcgtctgcagctgttgactcccccaacccgccgctcacaactacctttgcatggaatgtttgttatgtttgcatttagagaagcgctgaaacggaaccactcctctgctccctcttcccaagggaatttgtgtaaagtaggtaatataggacaaaacccacagcctcatctctaaggaggtgagaacaatacggaataaaagccagtttcaacttgggcttcttgaccaagcatttccagttcagaggctctcaatgaactgagctgtcaatgaactgagggtcaggaaagttaaccagagtgttagcacctaaacataaaatagtctcgctactggaggttagcagggcccagagcaagccactccaccacgatctgtacaaaagaccggtgcaggttgctgtgaagccagagaggcctccttgctgaacccttgtttaagcaccaaataggaaaatttgttttctgagactaacatgttaaaaaattctctggattgagtctttttctattctaatcaccagtgaacctttgttttttaagctttcattgctttttttttttttttagacggaatctccctctgtcgcccagactggagtgcggtggcgggatctcggctcactgcaagctccgcctcccgggttcacgtcattctcccgcctc[224 bp omitted]cagctagaaaaacagaaaagtaagaataattatcaccatctcattacccagaggaagctccgtaaatattttaatgtaaatatttacctttctctctttctatgtgtatatatacacatctataaatacacatatatactgtatatatagatgtatacatatctatacatacatatacatacccacacacatatatggatggaaagaaatatacacaaactttttatttttgtttatgtattttttttttgagacaaagtcttgctctttacccaggttggagtgcagtggtgtaatcatggctcactgcagctttgacctttgggactcaagggatcctcccacctcagcctcccaagtagctgggactgcaggcaaacgccaccgtgcccagctaaagttttttttgtttttgttttgttttgtttttttagtagagacagggtttcacagtgtttccccaggctggtctcaaactcctgagctcaagcagtcctcccaccttggcctctcaaagtgctgggattacaggcatgagccacttcgcctggccacacaaacttttaaataatttttttcatttatcagtatcttatgaatattttttgatgtcaataaatacaaatctatataatcatatttaatgactgcctaaattttcattatgggtgtaccagaggtaattatcatttattgtttgatattttgatagtttttctaattttgtgctgttataaacatgaactataaaggtaaatagctatatatctttctttacttttaaatttaaattaattaaaaataatcatatccaggcatggtggctcacacctgtaatcccagcactttgggaggctgaggcaggcatatcacctgaggacaggagtttgagaccagcctggccaacatggcaaaaccccgtctctacttaaaaaaaaatacaaaaattagctgagtgtcatggcgcatgcctgtagtcccaggtactcgggaggctgaggcaggagaatcgcttgaacccaggaggtggaggttgcagtgatctgagatcccaccactgcactccagcctaggcgacacagcgatactccgactcaaaaaaagtaataataataatcagtttctaaatttcacttgccacagttcaagtgctcaatagccacatgtggctagtggctactatattggactgcatatactatatatgcagataaagagcattaccatcagtaactgagtgaatgtctttgagaaggcatcttcaaaattgccaaatcgtccccttaggataaatttctagcagtgaacttgcttgctcaaagattacactgtatgcatttttagtattaaaaattcctcttaaacatactgttaaattgctctacagaaagtagcttcagtttactctttcaccaggagagtgtgagggtgttcatttcccctctcccatgccaacgcttgttagtaatattttaaaaattttttgcagtttgataggaaataaatggtacatcaccgttctaatttgcatttctttgattactcttaaagttgaacagtttttcatgttgattggcctttcatagttcttctgttgaggcttgaatgaatctgcttacagacttatttcctcgtttgtgattcttgcaatacagtctccatcccccaagattctgttttgctaagtctggggtggggcctgcatctgtattctttaaaaggaccccagatgattctcatgtgcacagaaacactcatctagaccgcttgtccactcaaggcaggaatgtcctttccacccagccctgacaaatgattatttagcttctccttaaacacccctgcctgttagagggctatgttagaaaaggttcttgagccgaaatttactgtgtaaatttcaccatgggctagacctagctctgctgttggagccacacgtttgcttccttcctcttttgcataacaacctctcaaatatttagagacagccaccatgtcattttaaaattcactcttcacaaagccaaagaggctacatttctttccttcgttccccacatgacttggtttcaagattcttcatatcattatcatcctgtttgggctcttttccaagttttctatgtcctacttaagatgtgagagacagagcataagctagaggatcagatctggtcttgaacccaacgtctgtcacttgcctgaattgtgaacagacgcaagtaacctggtctcattttccttatctgtgaaatgggaataaatagtagtacctcccttgtggagttcttgggaataacgaaggtaacatatggaaagtttctaatgtataagtgattcataaaggttaaaaaaagagatctggccaaaacaaaacaaacaaacaaacaaacaaacaaaaaaacagtattccagaaggatctgccactgaatacagtcagggagggggcaatgttttgtatcatttctgggtgtgagccgagaagccgggggctgtgtattcatttttattcccagcccagcccctcacacagtgtctggagtgcagtagattcttaggtgttttgtgaaaatacactgccaaccttgggtaggatggactcattgttgggagaagagcctggaggccaggaaatgacttaaaatacagttaatatagttctggagagagataacaaaggcttttttttttttttttgaaatggagtttcactcttgtcgcccaggcacgatcttggctcactgcaacctctgcctcccgggttcaagcgattctcctgcctcgggctcctgagtagctgggattacagatgcgtgccaccacgccccatataatttttgtatttttagtagagatggggtttcaccacgttggccaggctgatctcgaactcctgacctcaggtgatccacccacctctgcctcccaaagtgctgggattacaggcctgagccactgcaccaggcgaacaaaggcttttaactgaggcaatgagaatggagataagggagaagacataagaaacattgtgctgagaaaatcaacaggatttggtgattcttaaaagggaaggagaagggggaggaagaaagagaggaagagcggaggtggagtcaagataattttgaggtttctcagcttgtgtgaactgaaggaaaagcaagtttgttgataggggaagggaaaagaaaatgagcaacttctgtttgagggagttgtcagggcaaagccaggtttcagttaagcaagatggtggctgagcatataaggttgtcttttggcaaaggactagggttctcgagggcagaggtggaaagtgttccaagtgggttcaggaagaagaagagccaggaaaaggccagggctgagtggacagagatgaaattgtaggcgagattagctgattgaagaggtttgcacctttgggggtgattagggaagtgggaggcagggtgtggggaaacgatctggaggccagccccagacttccagttagaatggggtggggatgggaagtgagtccaccccttgggcagatcccactctggggtgggtctgagcagcagttgccctgaggagcagggggtcagtgaggggttgacttcctgctcaggtgctcaggaagaggctaataggatagttcctgcttttaagggagactagaagtacgcaaataacctacagaagatagaagccagataggagtccagtggtcattggtttcccagtcttcaccccatctccgacccccaccccagcccccagtgctctctcttaagatccttaacgtttttcaagactttcgtcctttctgggttcgacaaggttaaataggcctttactaatgaacattgttctgtttatggcatttcccacatttatttgaccacagaccctgccccacccccaaccggctttttatggaaagtggagagtaaatggtaacatctaacaggctgagaaattcctatatagtgtgcgtgtgtaactaactcatcttggcgttctcttacttgacctctgtggattgcaagcagtggttgctactttcccatgctccacgtcaagaaccacccttgctgttcagttcagaggagtaattcacctgtctgattgtgctttctcctgagctatagaattgtcagcaagtcatgttgaaagacgattagtttttaaaaataatttgtttatcatggaaggggaggccaaaactacatgagggtacagctcgagccatttcttctgtaaatcctaagggtacttagaatacgtttctctttgagatttacccctcttggtttaatttttatcaggcatgcagaggagttggtgggtaacattggcctgccgtttatatcagcctacagccagatgcctttttgattccttgcaggaccccaccctggacgctcccagagcagtagcttgaatggagcaaagagacagtctcagttagctgccattgcctttgtaagcttgtgcttcagagcaaagtggttaagagcttgggctctggaagcatgctgcccaggttcagagttcagccctagatgaccttgggccaattatttaaccttcctgggcattggtaaccccctcaggggcttgttgaaaggcttaaatgagttatttgttttgttttgtttttgagacggggtctcgctctgtcacccaggctggagtgcagtgacacgaacttggttcactgtaacctccgcctcctgggttcaagtgatccttccatctcagcctccctagtagctgggactacaggtgtgcaccaccattgcccggctaagttttgtgtttttagtatagagacagggtttt[138 bp omitted]gaaagcacttcaagtggggtttgccaattgttaagtactgatgactgttggctcgcattatcatccccaggctttatggtgggcaagagacgtcttttgtatatgtgttacaagtcagcagacagaaaagttaactggaagaggggaagcaggtacccttgctttaattccttgctccagatgatgccccaaaggggtgagccacatggctgatccaagaatcttacccttcctggaagaacaagctggcagacccctctgcatgaggttcttgccaatacccgttcccagtctgacttagtcatactgaaaagcctagtggatggtagcaagggttctgggtttttggcattttctaccttcacacgagtttaatgagtgagtgggaaggctggtcctcaagtggggagaagcactctgtcctgtgccttgggccggaaggctctccagactggggaaactgtacctgtggcctttggcagaagcacttacctttatgccagcctgttcagtgtgatttatgcaaaggggtgaatagaagagaattgggatctgtgtggaaaaacagagcttggacatgcctacctttccctttcaaaccttcactgatgccaggcacgttagcctatgcctataatcccagccctttgggaggctgagctgggaggattgcttgagcctgggagttccaggccagcctgggagatacagggagacccccatctttacaaaattaaaacaaaaatgagccaggcgtggtggcacatgcgtgtagtccagctacttgagagactgaagtgggaggattccttgagcccaggagttcgaggctgcagtgagccttgattgtgccactgcactccagcttgggtgacagactgagaccctgtctcaaaaaaaaaaaaaacaacaaaaaaccaaaaccaaaaaacctttattgttatccctttcactcttaatcctcacatttaatagtcaaataaatattgaaatgcaaatgcttttttaaagttctattttggggctgagcgcggtggctcacacctatattcccagcactttgagaggccgaggtgggtggatcacttgaggtcaggagtttgagatcagcctggccaacatggtaaaaccctgtctctaccaaaaatacaaaaattagctgggcatggtggtgcacgcctgtaatcccagctacttgggaggctgaggcatgagaatcacttgaacccgggaggcagaggttgcagtgagctgagatcacgccactgcaccccagcctgggcgacaaagtgagactgtctcaaaaaaaaaattatattttggaaacatacgttttaataggaaattttaaaacttaaagctgtctcgagaaattattcttttatatttggctattctggttttgtggtagcaggataagttctgttaaggatagtgtgtggctgggcatgatggctagtgcctaaaatgccagcactttggcaggctgaggtaggaggattgtttgaggccaggagttcaagaccagcctgggcaacatagcgagacccccgtctttccaaaaaaataaaaagaatagtgcacacaggttcctagcagagtcagtacagtggaaaacatgccgagtgttccagctctacgtggttcatcttttgtctgtgtgcagccttgcacaatcatgcctaaatttgctattaatgatttcctgcgattcttctccacttttattgcctattgagtttattgttcatgggaagttatgtgcttttgccgtttttgacttctgttggattgtgtatatgtttcaagctgctaagaaatgttagaagatattctgatacttcagcgttcccatcgcattgctttccctaatgactggaaatattttactgggtaagatttaactgagaagtcaagtgttgcttccaagtctctgagacagaacatctttatttgaagtgtttcagtgaagtgtgtcagaaggctggggaattcatttgtataagattttttttttttttccggagacagagtcttgctctgtcacccaggctggagtgcagtggcaacctccgcctcctgtgttcaagcgattctcctgcctcagcctcccaagtagctgggattacaggcatctgccaccacgcctggctaatttttgtgtttttagtagagacggggtttcaccatgttggccatgctggttttgaactcctgacctcaggtgatccatccgcctgggcctcccaaggtgctggaattacaggcatgagccaccgtgcccggcccgttttttaaatggtgacaagaccttgagtttttatagccgaaatcttaagacttaaaaatgctgttatatctatctgtggcctcatatgtctacaggtcactactgaacacatatcacatagtcatcacccctcttctgtaagtggggaaacagaggcatggttttcagtgaggcaggccataggttatttatattaatgaaatgacagagcaggtaatgaactccaggtgtcctgattcctttggagtaaccatgtgaagaaatactagagggatgccagattccacagtcaatcaggtggagaaagctctttctgtgtggttttggtgatgatctcgctctattgggaaacagtgtttatttctaaacaagcttaggtctctttagtgggaaagtaggaggtgaggacaaaaaaaaaaaaaagagggatggggttgttattgagaaatgtgggcaagatcagtatagatttttgcttgccaaagtaagcctaaggatattgagaactgtttgcaattggccatccctccttactttgctatttgaataactatatggaaaaaaatatccagaacactggctctgcagaggtacctgggatcattttcatggaactgttttcatgatttttttcaagtgggttagtgctgtccaaaaataacaacatatatatttctttccatgccttttatattagtagtttagttttcccacttgagaaactgccagctttatgccttgcagggcctgttgtcacagtgttcacggtgtgaatggaagagtgctgttggcatggccagtttactttcataggtgaacacgttcctaatgcttcagtacattaaatcgtttcctagagatctgaaggagggaatgctaccttccaaggtacctaccttcccaccaagaaataacttaagttcaagaaggttctaaatcaaccggtacatacatggaactgaatcgttatttcaaagctcacaggggccaatagctctcgttgtgtccagccgagtgtttacgacatgctctatagtttgtggagcaaagaaagccctcccttgctaacttgaccctggggagacttgctcctctactcctagtgaccgacatgaccacttgcaagggaacttggcctccgtctgtccctgctaaatggtctggcagaattctcatcaggagagccagaagaaaattccataaggcttctcgcttcagttctgtaataacaaacccagctccctctccctgcctgccctgcttcctttgctcagtactgcccctaggctcagagacatcagggagtctcatattcagagcccaggttcttcaagtccataggctgctggttctgccctgcctttaaaatccatttccagtcaactggatttggatcttcttgtccccttgtgtctttgtctcactcactgtatctctgtctggccccctagcctgtccatagctaaccccctgcctcagttttctggctaatcgcccagttcctctaggagtaagttcttgccttgttgctggccttcctgaggaggggtgccttaccctcaccaggaccatatgactgagcccagcacagtggaactgtggattgaaggggtgagtttctctctttttttttttctggaaacagagtcttcccaggctggggtgcagtggtgcaatctcggctcactgaaacctctgcttcccgtgttcaagtgattctcctgcctcagcctcctgagtagctgggactacaggtgtacaccaccactcctggctaattttttgtatgtttagtagagacggggttttaccatgttggtcaggctggtctcgaactcctgacctcaagtgttccaactgcctcggcctcccaaagtgctcggattataggcgtgagccactgcacctggcctggaggggtgagtttctgcttagagaactcagaggagacaaagtgcctgggataacgcagtccagcaagtggccctgttgaggactggactagctttatggtctattagtttcctattgccactgtaatgaattgccacaaacttagtgtcttaacacagatgtgttccagttctagagatcagaaggccaaaattggtttcactgagctaaagccaaggtgtccaaaaagcctcacttcctccagaagctgtaggggaggatccattgcctggtctcttccagcttctagaggatgcccacattccttggctcatggccccttcctccctcctcaaaccagcaatgactggtcgagtctttctcacatcctatcagtctcacactgcttctgtcattatatctccttctctgacaccggctctcttgcctccctctttcacttataaggaccttggttccaccttggtaatctaggataattgccccatctccaaatccttaatttaatcatgcctgcaaagtcttctttgccatgtaaagtaacatattcacaggttccacggattaagatgtggccatcattgaggaaccattattctgcctatcacgcaagatgtcacccaagtttgaggactgatggaatcctggggtcagaggggttcccagcacaggtcctgacattacagtggaggaggaacagggatctggcaaacagccaggcgcagaagtcttcatagaattcaaatgaggaagcacaatcccttttgcgaattttggctgaaagaaagcaatacaggtctgcagtctgcaatttcaattgacatgttttcttaaattcttcataactaaatgtctttccccacacaggactccctgagcctggagttcttatagcgggcactgctttcagacttgaggtgttttaggatacaagctgggcagacactttgcgggcatttagccagctcaggcctatagaattttccaccttcagttaaagaaaagagcaaagaggtaggggtgtgtgtgggtgtgtggatgtatgtgtgtggcggggggtcagcggggaggtgtttaaaagagaaagcgatggttgcacatcacataaaataactatttggccacaagtcccaagatacctctcatatgtcctgtgtaagagatgctttgcccagcctgaaggtcaagttagactgggcatggtccttctgcattttcaaggtaatcacagaatcccttcccagaaatggctttctaaaacacatgattggagaagcagaaggaaggactggaaaatctatctgagttctttctggcttcatgatgatttcaattaaaagataaatggaaacttcccctctctaccacatctagtcactgccatcttagagacacatagaacaaaagtttcctggctgataacatttgcatcagccctcctcacactggccagtatgatgtccatgatgtgtctgatggcacagagctttgctgtcctgaagaagcactctatcgtagatgtggattgcatttcctatttttaccttggttctaattggccacggccatatttctcccaggcccagcatatcttttttcaagcctctggctaattgacctggctgtaatgcactgaaaatcattatagaaaaggttggggaaactcccagattgtgtttgaaaatctgtagagacaaaatacacattcactatcttcacttttctcctgttctattttttctttttttcctcctcaataggaaaacagtttcaattctccttataaaccatctcagggtaaatattcagatgttttcagtggaattatgttaaaccattttttgaaagtgcttatctacgatgaatatctactaattattaaatgtgaaagggtattaactgtagtcctatttaaatcttttttagaaaatggtgttcattttctgtaaattgtgggtttattctcttcaacctggcttatttgattttattttgcgatttactactttctgctttggagtttctccttttctctattggctgtcagctgaacttcaccgaggcttctgggtactgtgcattaggtcaatgagcttcatgacagagttgacgcctgggaaccctggaacctctggggctgtgttatgcagcagaaggaactagaaaggaggagggcgttgctggagagtgagctagagagagagaaagttgtgctgagctgtggaagatggctcccctggctgagggagaagacagataccgtcgttcagttcatgctcaaatcccaagggaaatgtttgtgaactgttgcttgaattgaagagaagcagagaatctatttccgcttatttatttatttattttttgagaaggagtctcactctgtcgcccaggctggagtgcagtggcacgatcttggctcactgcaaccaccgactccggggttcaagcaattctcctgcctcagcctcccgagtagctgggactacaggcgcacgccgccatgcgtgtattttagtaaagacagggtttcaccgtgttgcccaggctggtcgcgaactcctgagctcagacaatctgcctgccttggcctcccaaaatgctgggattacagcgtgagccaccatgccctgctccgctgatttctttttaacagatcaaacctacttacgacaaggaggtaggaggaatggtggaaggcaagaccagggcttaatctcaagaaactgaaggattaaaaaggggcaaaaggaaggtattttttttccattacaaagaccaagagaccagagattaaaatattaacaatatttaatgagtgcagccgtatatttttagattcagacaggaagagatcaagtcctttagaaattgtgcttgataaatgaaacagttttgtctggcaccaaaggggtgagtagatacttattcaggggctggagacagtgcatatactgtcaacttgcatgatgcaggacctcaaatcagttagttaaggaattgagaaaatacttgtatgccattcagcatataggatagttggaacatagggaaactcattctccaacttcaatggaggtcagagacacatgaccatcagacacccataggggccagatttctgttgggagcccagggtagagggactcaggtgctaggtctgcctgccctccttttttccatcctatcctctaccagggtagaaggggagccaacagctcatgcctctgccagacccgtgtttctcaaggcagaaaacgctgcttgacaggaatggtggccatagaggctgccactctgagcccttgtgaccttctctgagagcagcccccactgggactggcttcttcttactgactacattctctttcttgcaagctactatcttcccctttccaccttctactattccctaactgctttccccccattctgattttcctcaactgctgctcctggtgtttgcctctgcactgccaccttccaggaaactcttctgtggatctggctgcctgatccagctccttgacttctcccttctaccatgccctgggaaccattgtttgactgtgggcacactccttctctccccttctcatctttttctcacctcttctttctctctcctctgtttggctaaaaagtgtgctttgtggcacagagccatcactgtgtttattttttttaaaccttttctttagccaaggatggaaaattccaaaggcctgagctagtgatggctggatgccttttctggaaatccagtggcctgggtgccaagggaatgttgtggagctacacatctggcaaggttgtcccctaaaatgtcctggctttggatttagttccaactgaaagaaggggaggttctatctggaattatggaatcagaatgaagagttagctaggtgtggtggcacacgcctgtggttccagctactcgggaggctgaagcaggaggatcacttgaacccacttcaaggccatggtgaactatgattacaccattgtactccagcctgggtgacagagcgagaccttgtctcaaattttaaaaaaaagtgaagagtttacgaaattatgtaattgtaaccccagagcccagtttatgtcactgtttttttctgctgggtttaattgggaaagagtggcctttgacttagtagatctttaaaaagtgaaaccttttgcatgagagtcaaataaagttcttgcacctcagtttaatcgatgattttgcttcgttggggttacttggcagaggccaggcacacttcagagcacctggagtgggccttatgggggagcagcagcatcattccagttgttaccaggtgcagttgagtaggcctactccaccttcatgtttcttgccccctcttggagaaataatgatatggtttggctgtgtacccacccaaaaatctcatcttgaattgtaatccccataatccccacgtcaatggtgggaacaagtggaggtaattggatcatgggggcagtttttctgcatgctgttctggtgatagtgaatgagtctcatgcatatctgatggttttttaaacgtctgacctttcccctgcctgcactcactccatcctgccaccctgtgaagagggtgcctgcttctcctttgccttctgcctggactgtaagtttcctgaggccccccccatcaatgctgaactgtgagtcaattaaacctctttcctttataaattacccagtctcaggcagttctttattaggagtatgaaaatggactaatacaaataatttggccagagttttgtgcacacgttcctgcggggtgaaacaagtcagagttgaccaccttgatggtaagcaaaaagttattgtcttgaaatatctagaaactgtaccattctcctacctcttgagagcgtgggggagattaacaatacccaaacccataaaaatgccaactctgtctgcactggcttcacattgccataaacacccagatttcctagaggggacttcatggcccttcatgtccaccagtaaggaccatcccacctttgaagtttcttctcccaccacacccttcctttgccctgtagtctagccacattgaaccatcacactttttcaaacacatttctatagtttctcacctacatacctttgtgcatgctgactcctcatccggggatgcccttacaagcccttccctgctaaagggaatcctatctgtccttcagggcttaggtcaaatggccatcttctccatggccaccatatttggagctaattgctccttctgcagccttacagcctcttactagttgcgttggcttcctgtggctgctgtaacaaattaccacaaattgggtggcctaaaacaagtttgttctctaacagatctagaggccagacgtctgaaataagtatcactaggcctcactccttcaggagattttaggaaaggatcatttattgcctcttccagctctggtagctaccagcattccttggcttgtggttgcatcactccaatctctgcctctgtggtcacattgccacctctttggtctgtttcaggtctcccgctgcctctttcttatcaagatacttgtgatggcatttagagtccaccccaataatccggatgcgctcttcatctcaagatccttaatttatttcattttgttttgttttttgagatggagtttcgctcttgttgcccaggctggagtgcaatggtgcaatctcggcttaccgcaacctccgcctctcgagttcaagcgattcttctgcctcagcctcccgagtagctgggattacaggcatgcaccaccatgcctggctaattttgtatttttagtagagacggggtttcttcatgttggtcaggttggtctcgaactcctgacctcaggtgatccgcccgccttggcctcccaaagtgctgggattatagatgtgagccactgcacccagccaatttatttcacgtctgtaaagaccctttggccatatatcatttgcaggttccagggatgaggatgggggcatatctttttgtgggggaggcattttttcagtctgtgtgttcttaggttttagagaggattgatatcagtactttcattttagagaggattgatttcattaggcctcctaagatagttgttgatagcttctctattgtattagaatgtaaataccttaaggggctggtaggagactagaaagctattgcttagtagtcagtgccagagggcccagcaattctactgacaatctgtgttaccttgggcagactgtttgacttttgggggatctccttttgcttatttgtaaacattggaagaataacatgaacatcaattggccttgcaaatatgtttataatagcaaaaacaaaaacccaaaaaagttcacctaaatgttcaaaagtaaggatttgggcaaatatatatatatatacattcttacaccagaaaactgtgcagtccttaaaatgacattctttctttcttttttcttttcttttctttttctttttttttttttttttgtgatggagtctgcgtctgttatccagcctggagtgcagtggcatgatctcgactcactgcaagctccgcctcccgggttcacgccattctcctgcctcagcctcctgagtagctgggactacaggcgcccaccaccatgcccggctaattttgttttgtatttttagtagagatggg[145 bp omitted]tttttcttctttctttctctctccgcctctctcacactcgctctgttgcccaggctggagtgcagctgtgtgatcttggctcactgcatccttctccccctgagttcaagcaattctcctacctcagcctccctagtagctgggagtgcactaccatgcccaagctaatttttgtatttttagtagagatggggtttcgccatgttggccaggctggtctcgaactcctgacctcaaatgatctgtgcacctcagcctcccaaagtgctgggattacagacgtgagccaccgcacccggctgacatctatatttattgacagtggcaaaaaatttacattatgaaatggcatgcaaagtatgatcctatttttataaaataatgcatatacgatatatgtgaatatacttacctaatcactctgtgcctcgttttcttcatctgtaaaatgtagataatgatagtactgacctcagaggcttgttgcaaggtttgagtaaaattagacattgaagcacgaggaacaatgcctagcacatagagaagcactgaataaacgtagctattagtattattgttatattcaaaacaacattcccaaaggatgttgtatgttgataacatatgtttatatataatgcgtatatgtgtgtataatattaagagtgctagatgggcacactggctcacacctgtaatcctagtgactcaggaggctgaggtgggaggatcatttgagcccaggagttcgaggctgggcaacatagccagacccctgtctcttaaaaaaaataataaaattagctgggcatggtggtgtgtgcctgtagtcctagctacttgtgagtctgaggcaagaggattgcttaaacccaggagtttggggttacagtgagctatgatcgcgccactgcactccagcgtgggtgacagagtgagaccctgttttaaaaaaaaagaaaaataaaataaataaaagagtgcctatctcggatggtgggattatgttatgaggaaattttatttttgctttaaaaacattaattcatttattttactctgagcattattatttttataaacagaagatgtagagttcaagataagaaccatactttcaggatttctagatttatgtgacacgcatgtgtgtgcacacacaacatatggtctctctataattagctattattattaagataatttttcctataatcctgcagctccttgcctagtgctttgcgtatctcagattctctgtctgctagatcattaaaattaggatgggctagagattagactttaattcccacttgcatttaattcctatcttcttaagtattattccctgaactttgattataatgtgttttctttaaagtgaaattttgaagaatatatgtatatagtcttacactagatatttgcctgtacatccacatatatctatatatttcatattatctttataattttggggaggcctaagtgcctactctgaattttctgaactgtaaattaaaatagctgctatgttgcgtgtgaaatgtatctcaggttgttgatactggagttctcttttgctgccattaagaagatgaatcactagagggacttaaatttcaagtaaagctaattaatttgcattgaaattgcaaggatttgtggtcatgatttttctgattttgaacatgctgaatctttgttcttttatttaaaataatctttatacttctcatggatttaaaaacaaatggatgggagaattacttatgaattatgagctttgaaatggaaggtcttgcctctgacatttaaaacaattagattatgatgcgcatcttggtaggcaggggctctttccctctctactgtgtgcctcttttttctgtcagcatgcatgtccttgagttcatttctttcttccttctgttcttctgtcttctctctactatatgtctctttttcttacaagatatataaaaatgatttgttacgtttggtggtctctgcctgtagtctcagctactttagggagaccaaggcgagaggattccttgagcccaggagttcaagtccagcctgggcgacatagtgagacccccatctcttaaagaaatggtttgttgtatttaaactgggatttggatatttcctctttgtaactgaaaaagtagggcaaatgaagggatgaataagtgaagcagagaggatttttaaggcagtgaaactactccatatactactgcagtggtggatacatgccattatatatttgtcaaacaaaacccatagaatgtacagcacctagagtgaatcctaatgtatcctatggactttgggtgttatgatgtgtcattgtagggtcatcaattgtaacaaatgtaccactctggtgcctgatgttgatagtaggggaggctgagcctgtgttggggcagggagcacatgggaactgaactctataatttctgcttaattttgctgggaacctaaaactgctctgaaaaatagtttatttaaaaaagtaagatctatgaaatttttttttgtcaaaaaatatcctaagtgtagttcttttgcatttccgtggacctttaatttttctgcctgtcagtagtcctaatatttttttaaaaaaactttttgtcccatctcgataatttggaagcttgcattcccagctctcttgctgacttgttcggcataattatggagacttacagcaaatgagaattgaatacttcgaaggctttgaatgaaaggtgccaggtaaaagcaaagcaatttt[131 bp omitted]tggccaacatggcgaaaccccatctctactaaaaatacaaaaaaattagccaggcgtggtggcacacacctgtaatcccagctactcgggtggtggaggcaggagaaatgcttgaacctgggaggtggaggttgcagtgaaccactgcactccagcctgtgcaacagagcttgactctgtctcaaaacagaaaagaaattttaaggtctgctcttcactgtgtgaccctggaggcaaggcgctgatgaaatgagtatgtgaaccaccaaaatcatggtgaagaggtacctgctaaccaaattcagactttggagcagctgtgtttcctcaatgtggcccatatgtaaatcaaatttgggcaaatcacgtcatttcacatacacttggggaatctgatttttgaatgaactttattggaatcctttggaaaagcaaagcataattttgtaatgcaagtaaccatccactaatttatatttttttaaggcagggttttgtgaggtgggatttcagtttttgtaacacactgtcactcctctgccatttaaaatcagattatacctgggagagaaggataactctgggaagttgcattaactccttcagacctgaagaaggcatttagtcaattattgtttctgggaactaaataatacccttgtcactcaaaaaatttaaaatagcctttgtaagtggctcctcagtctctaagagaacatgactcattctttctttgtaacttgaaagaaatccaagtgtcagaagacactgggaaatggacttaagttacacttctaaacatcagtactagagatcttaaatattaggaaaccaatatgatattggtttaaagttgatggttggagccactgtattaggatgaaagggcaagggattgactggcagtgctttctagaatattccttggggaaattcttgctggcagcattaaggctcctgagctctggctgtactctgtgtaccataggctgtcctgttcttttgtccagaaagcccactccctgcttttctaactgcctcatggttacacatggcctcataatgtttcttctgccagcttaatttatggttgctttcccctcaagcagcctttggatccatcttctgcatataaccagtgaaaagaaacggagtatattagaagatgccttgcattagtgctgggagatggattgcattcctgtacttcttaaaacccatgtccttgataatacaagatggagctgtggagggtgaggttctccatgtctgggttcgcctttgcctttcattgacctcggtggctgccagtcaatggaaaaatatgatcagggttcaccctatggaatcattgcttaatatcatagatgactcattggaattagtgttgttagaaaatcacttccagatgtggagcagaaacttttccaaaagagagaaatacactctggaaaactgggttttattatttttttaaatgatcttagggccagaattaaatctgcttgtgcgtggttagtcaacatatatttggagttctaagtagtacaatcctgttcacttcctttagactgacatccacataagtgggggctgcctttagcctgcttccttatcctctgtcaacttctgccctctccacatctcccatcttctcacagtgatgaatggcttggaagccttatctactccctcaggttccggtctctcattccttatcattaccagcaaaatttattgagcattcctagatactgtgaaggatggaagaaacatctagttggaaagcaatagaagttttggtcatatagctaagtgactgagaatgagctctggtgtccacttctgagttgaaatgccactttctggctgtggaatattgggaaacttactcaacctttttaagtcccagtttctttgtttataaaataggagtgatggtgataatcatacctaccgcataaggtaagcatgaggcctaaagggataatccatggtcaaccctttgcataggctaagtgttagctattattattcatcaattcacctccgtgtgtagtttttgtatgaagggggaacatgaaccattagttctagactgacactctccaaaaagcaaccacagtgtttgaattttggaattctctttaagtttatttcactgcagcagagaattcactggcttctcatattcactacatttttagttgtgccctgttaaaagagggaatgtgttgtcatctccttggaagcaccacatgacagactttgtagttcacgcaatagtcagaaggaaagtatttgtaaatagcataccctggagctcttgcaaaagccacgtctattctaataaggtgtttttggtaaatgaaatcttatgttttccatcctacttatttttcacaacgtaacctattatcacattgtatttgagtagttttctattgaatatgtattctcccctccctccatctcaaatgtaacatatcaataagtgtgtttctatactagaatgtggtaaaaaaaacatttctaaaacttgaaaactgcactagaagaagaaaatatcataaccattcctattacatagagatttacattaatatctttactctttaaagcattgaaaatgtttgggaattcacaaaactgctgcagaatctgctgtagtggttaagagcatgcacttggccaggctcattcctgtaatcccagcacttggggaggctgaggcaggcagatcacttgaggccaggagtttgagaacagccctgccaacaaagcaaaaccccgtctctactaaaaatacaaaaatttagctgggtgtggtggcgggcacctgtagtcccagctactcaggaagctgaggcaggagaattgcttgaacccagggggcggaggttgcaatgagtgatattgcaccactgcactccagcctggggtcagagtgagactttgtctaaaaaaaaaaagcatgcactccagagttaaatagagcctggctttgaatcctgactatactggttttctgttgctgcatagcaaattaccacatacttagcagcttaaaataacacacttattatttcacagtcagaagtgtaggcatggctcagctggattctctgctcagggttttacaggtgttggcaggactgcattcttatccagaagctcagagcttttccaagctcattcaagatagcacaatttggttccttgaagtagttgaaatggtcccattcagctgggggttgctgtcacctcctagaggacatcctcaggtcctggacagataggcctctcatcatatggcagtttacttctttaaatccagcaggtgtatctctctcttcaggatgggcccagttcctcttctagagatcacttgattaggtcgggcccacctggaatcctctctgttttgattaactcacagtcagttgattcctgacctaatcagggtagggatatctctcaatattcacaggtcccgcttacattcaagaggagaattaaacagggtgagtagaccaggaggcaagaattctaggggcatctcagaatttggcgtactacgctgactctatttgctcacttgggcaagtttctgacctctcttaatctgttttcccattgataaaatgtgagtagtgatagtattctctacctcatacagtcattgctaaaattaaatgaggtaacgcatgtaatgcatttcgcatagtacctggtgcttagcaagctttcaataaatgttagaagcataatagagaagagttacatttcttcctcctgtcctacattttctttcatttccccaccctcataatgaaatggctttgagggtaggacatatggtcacatgctaaagaagttgagtttttgcccttaggatttgaattaaatacaaaaaagaacttactgagcataaaggttgtttaacattgaaatttctaagccatttgtatgtctaggtggagacctttctagaaatatccttctcattggattcttggttaaatgaatgcatgtgcagcaggcagttcatggggttttaggtgtgcttcctaggtaagaagattttaggttatttactctgcttatgaaaagacagtttggtaggttggtgatctgtaattgtcaatacctttcaaaaacaaatcagtactttgtagagcgagaaatttcagtttacaggacctgcactgtgcactgtgtttctcacgtttagtaaggatattcaacagttcagcctcacgatagtcctgaaatttggactgagtttattcacataagctactgagacacagccatttctagaggatttgagtatagttccggggctattcctagaagaaaatgaatatgtattgctttttctcattgcctgtgtaaattgatcatactcaataatacttagaaaacaaactcccatgtgacaaatagttggttcgaaggcccattttgcaggggggactgaagagaaaggaaataaggggcagagagacaagaaggggagtttgatcctccgagatggaactgaacttgggtgtcacttttcacaataattactcaagcattcctctccattcagtagtgacaaatctgcatgtttgtcttctatgtgagaagtttggaagtttgagtgtgtagttaagaaccagccagaaacagagagctggtagggctgaggaatcgtataagcctgtaagatctatgtcctccccaccctgcctgtttgcccttgctgggctcactaccacacccagatgagtttcctttctgtgactgtcattagtacacaagtgccccaccgcattagctgcctaaaaaggagccaagttgggggacgattgatgagtttgtgacctcattgagaatacctcagttcttgttccttcacccacagaagggtaaaaaggaggtattaggcgtaccttctccatccatatttcaggctgtctgtttgctccctaaaaattcaacccataccttctttaaaaaataaagttgattacattaactttatttgtcggtgtcctctgatttttttctcaaatcagaggacactaacaggagagtaaaaaggcaacccacagaatgggcaaaagtatttgtaaagcatatatctgataagagattaatgtccagaatagataaagaactcctataatgcaacaacaacaacaaacttgatttaagtcaggcaaaggacttaaatagacatttctttgaagatgataaacaaatggccaataagcacgggaaaagatactcaaaaccattagtcatcagggaaatacaaatgaaaaccacaacgagataccacctcacacctgttctgatggttgttattcaaaaaactggaaaataagtgttgaggaacacgggcggggcggacctggaacccttgtgcattgctggtgggtaatgtaaaatggtacaaccactatggaaaacagttaagtggttcctcagaaagttaaatatagaattaccatataatagactgggagaggtggctcacacctgtaatgccagcattttgggagaggcaggcagatcacatgaggtcaggagtttgagacaagcctggccaacatggtaaaaccccatctctactaaaaaatatgaaaattagctgggcgtggtggcgtgtgcctgtaatctcagctactcaggaggctgaggcaggagaatcacttgaacccagga[135 bp omitted]cccaaaagaattgaaggaagggactcagatacttgtttcacaccactgttcatagcagcattgttcacaattgtcaaaaggtggaaacagcccagtgtccctcagcagatgaccaatggaatattattcagccttaaaaaggaaggaaattatgacacatgctacaatatgcatgaagcttgaggacattatactaagtgaaagaagccagtcacagaaagacaaattttatatgattccacatatatgaggtacctagaataggcaagtacatagagacagaaaatagaataaaggttaccagggatgggcgggggcggtgtggaggaagtgcagagttgaatgcgtacagagtttctctttgggatgatgaggaagtttggaaatgggtaatgatgatgattgcagagtaatgtgaatatagttaatgccaaatgcagacacttatatagtatatacttaacgaagtatatactttaaaatagttaaaatggtaaattttatgtatatttttaccacaataactaaaaaaaccaaattaagttgattgtatgttttggattataccagcggtacttgtttgtgctagaaaactctgggggaaaacagaaaaggaaaaaaaaagaaaaagaacgtaacacctccatttggaatacataaatctttaatgttttgatttgaccatgtttctttttaactaccctccccttgtcagcaaaaatgacaatcactttctaccacttcccgtataggtggcaaaatagtgcctacttattccctgtgaaatttccatgtcttaattcacaaacagaaaagaaagaagaaagacctgagcagtgaaaaacatcgcttccctgctgggcattctgttgtaaacctatccttagcaaggcggtagttcccaggccatgacatcttgggagcagctaccaagacaagcacaaggacctggggtcagcaggtctggcttccagctccagtcgtatgaaagatatgagccagggctttcaagtcttcagtcattctcacatcccttactaagccacagagcaacatcacatttagccatattgaatcaagtcctcctcataccgagcatggctcttgcttcagagatgtgaaggctgttatctcttgtttcctctctcagctagctgttctgtcaatggtctgtccccagggcccttcaaaaggaactctggccaagggtccctgagggagagaaagatgccagagttttacaagggctgcctttgcctgtttgtccgatgactacttgcttacagtctgaacgtgagtgctctcaggttgtggtgtttatgagaaagcaggggccagcccctgacctggccagagactgtagtttctacagtagtgccagtacattcctgggttctgggaaactttactgagctaggcccagattgctccctaagagaaacctcccaagggtcagaggaaagaggaaaaggctcattgatttaacagaggacagagtgactgatagagaaaaccattaaacatttcaattggcttttccttgaattttagaaagggacttatttgttttcccactggaaaatgggatattatttaaatatgggatgaaaattacattggaaggactggacttaaatggccagaagtccttcattgatccaagcaataatcctgttttgccagaattctctcaatagtgaaatatgtaagcagcagtgaagtaattacaccaatcttcctccttaaacacgatgggactccaaaaacatataagtgatgtcctttgaattgtcacccaccacaggaggccacataatcactccctaatgttttcattgctctaaaacccaggaatttccatctgtaagtttatgattcgtgtgagatacccagggcctttactatatagttgtatttcatgtactgtatatacttttatcattagatgagtgtctgcattttggtagtaaaggaaaactaccatttaaacaaaacaacttctactggttttattgtgtctctccaagactataattacatctgctttttttcccaattgatatagatccagtcattttacgtgaaaagatactctttcttaggctggggcttcacatagcctgttgaaatccttagaatttttaaacaccttgtgtgaaaacttagttaagaatttccctctcttacttttggagcaacaaatatttgttggtggatacatcttggaaatcaaagaggtttttgaactctggtccgaggttccttgtagtcagaaatttctcttatattactgggaacaccgtaactgctagaaatcaacttaatcagcagtatgaatccattttggaagaagaaaaaaatgaaaagagatggagaacatcaaaatgttaacagtggtcatttatggatggtggttttccaagtgacttatattttcctcattatatttttggattaaaaattcttcaacaaacatgtattgtttttataattatacaaaaccaatacatcttatatgatgacaaggcaacctgtttatatgaagctagtaaggcagtagattataacctttcttgggccacacactcctttgagattctgggaagctgtgaaccctctccccaaaaagatgtacatatagcaccttccatataattttagtagtttcacagattctgtgtagcccatccaagaattgactaaacccccagattaggaactactttaggaagtggatagagtggtaccccaaaaggtattggctgccaaataaatgtagcaggatgcagagttatatacatgttgttggcatcattgtggaggcatctgattcagggcacagccctgacatcggactatgcaaattgattgggacaccattgttatcgtaagagagaggaatttttccattcacgaagcctcaagtgtactgttcttctataggctgaggcatagggagctgccaaggtggaagtcaaaaccttgaggggcaggcctgagagcccagttgatcccagggcttgtatctatgtgaatgaagccgccccacccctggcacccagttgggattttctccagcagcagctgcaaaggctggaagccccttggagaagcagcagagaaataaatgagaaggggatttgatccagggctggggagtggcggcggatggcggatgtggttcaaaatgacaaggggtggtgggggaagaggtcccagttgaactgaaaatgaaagcaagacaggaacgcactgtcacattgagaggatagcattttagctggagaatgtacaggagaaggtgtagacatagttttgtctgtgtcagacaccttgatagcaaacactataggtagaggcttctggaggcaggattgctcttagtctaaggtcttatggtaacatttgcaggggatacgggttagcattacaaaatggggatgcttcaggaagggcgtgggcgagtgcttcttgctattacttcttgtaaccaaagctagtctaggcttttgggtatgttcaacactgcatggcctttggagcacttttatgggaagaggtaagaaaatgttcctgtgggcacatttagcacacagactaaatgtgagcttcaaggaagggagggtgggtgggatagacagagagagagaggttgtttaggaggaagtttgacaaggggaaagctattaccagcacaaatggagttttgcttgagtcatcgacttcttctcaggtttaattcaagtgcgcaaccaatactgtttactttttcttttttttcttttttttttttgagatggagtctcgctctgtcacccagactggagtatagtggcgcgatctcggctcactgcaacctccgcctcctgggttcaggcaattccgtctcagcctcccaagtagctgggactacaggcgcgtgccaccatgcctggctgatttttttggtatttttagtagagatggggtttcacc[138 bp omitted]tgccttgttctatgaaaacttcatatatggcattgtgaatttacaaaaagataaattagtgagtgatgattcatactattaaaagtgttcagtagcagagctcctttggacagctaccctaatgtttgcctttcagtgttttagagattgtggtcatctaggaaagattgtaagaggcagaaaatcttaattctgaaggttaggaaaatattgaccatggatttgtactttgctcatttgaagagctagggacagagcagtgaataagacaacgacactacaatcacagaactttcatttaagagggtagagagacagaaaaggaaacatcaggcactgcaccttggcacctctgaaatgggctgggatggcgaaggaagcgtaggaaatagaatagctctgggtttcagaaggtgcactgaataggaagaagtggtcacctgtacttgggtagataaggcagcctcttggggtcttgaggtggggggagtagacataaccaggcagagaggtcaggatcatcaaatatgagataacatgacccattaggaggtctacccaccctgattggaggacatggggctggaggctgaagatggagaccagatcacaagggatctaataagccttgctgaacagtttgagctttattctacagactctggtgagccactgaagggattgaaacaaagaaatactgtgatccaacatatttctcatcaaaagttggaccattttggatcaaattagccataggaaaggtgttgggaacaaattaagtacagattggcagctgatcttttccaaatgaaatattctggttaatctctgtcacacaaggacaatgcaaacattttctctctcttaaagaaaggcttttcacataagcagagtcctcactttattttcctcaatagttttgtatgcaactctaatgagtagttttccataattcagtgtattactcctggaaaacatagacaataggacaaatttttagcctatgctgtcattttatggattaatttccattaacgttgaccttctggctttcagtggataaatgtgagtaaaacatctgttcatgtcattcccttgcttaaaaaccacttctggctccccatcacctacactaggaaacagtctaaactcattgacttggcatatgtggtcctccataaacgttccttcccagctcatcttggccattcctccctgttctgtacaccccagaatcaatgaacacatggctttcttcttctttgctaagacttatgctctcttccttgcctgccatggggatttttatttcatccttcgagtctcagctcaaaagctatttcctctctgaactgccttcaccagtgatatgaatcactcccttccctgtgtctgcatggcactctctgtatcccctaccctagcccttactccattgcatcatagctcttgatttagggatctctctctccctctagcccatgagtttgttaagggcagggcccacatcttgcctgcttttgccttcccagctttgtagctccactgcctgacacatggttaatgctcagtgaatctatagaactaagttctatgttttctatttctgtttataagattccagaagagccctcggggaatgacagagcagcaagcctcacttttgtagcaggctggtctgtgaaatatatggctatggtgtaggaacctcaagcattgaaaactaaccattggaatgaagagcaacatgatttctgtactgagaactcatctcttactaaatattggagattttgttgttattgttgttgttgttttgtttcgttttgtttttggatgtataaggaagtgaggttgggtgcagtggctcatgctggtaatcccagcactttgggagtcaggcaggagggttgcttgaggccaggagtttgagaccagtctgggcaacatagggagacttcatctctacaaaaataaaaaagaaatagccaggtatggtggtggatgactgtggtcccagctactcaggagactgaggtgggaggatcccttaagcccaggaggttcggggctgcagtgagccatatactcaaaaaaaaaaaaaaaaaaaaaaaaaaaaaaaaaaaaaaacaggaagtgaagctgagtaattttatgttttacttttcttgacagcctttgagatataatcctcattctatacagcttaaccatttgaagtgtgtatatatatatatatatatattgtttttttgaaacagagtcttgctttgttgcccaggctggagtgcaatggtgccatcttggctcactgcaacctccgcctcccaagttcaagtgattctcctgcctcagcctcccgagtagctgggattacaggcgcccgccaccacatctggctaactttttgtatttttagtagaggtggggtttcaccatgatggccaggcaggtctcgaactcctgacctcaggtgatccgcccgcatcagcctcccaaagtgctgtgattagaggtgttagccaccacacccagctgaagtgtatattttcatttttagtatattcaaagatatgtgaagtcatcgccacaattttagaacattttcatcacttcaaggttatttgtttaagacagtcaaaaaacctttcatagaggtcaactcttaagacttcttttaaatggtatctctggtgatagggggtttgtcatagggaagggaattggcttaaagaagaatataaagattatagataggggcaggcttttttgtttcagaggaggatgtgtaataaaaaaaaaaaaagctgaacacccaagggatggtttaacggatgctggtctgacttaacaccctttctaaggatagagagaggctaagctattggagctttcatacggtgagaccctataaagttatagaacatggacaggaaagtgagacatgggtttctagagagacaagaattgggaaaataattacaacttattaataggagagtatgctgtaagcttaattgaacttgactgaagctacacgagagcaactgaggaccaggatgtgttagggccaatagaacggtaaaattcagggcatgatcaggaagggctttttggcaggcatctgtagacacctgcctcacctcac[174 bp omitted]ggtggtgggcgcctgtagccccagctactcgggaggctgaggcaggagaatggcg[150 bp omitted]cctcaccatatcctgaaatgttataccacaaggtggagcatctcctgacattttaaagataaagaggtaaactgaagtcaaaggagctatcactttatttactttacatagcttttatttatttatttgtttgtttgtttgtttgttgttattaatttttgagatggagattcgctcttgttgccctggctggagtgcaatgtcatggtctccgctcactgcaacctccgcctcccgggtttaagcgattctcccgcttcagccttctgagtagctgggattacaggcgcccatcaccacatctggctaatttttatatttttggtagagacagggtttcacca[134 bp omitted]tgtataaacttaaaatattggtgggcccaaaaaaggtagagataatttcaattaatggatagattcaatgtgatggatggtggaaaactaaaatatttgtagaaaggtgtatttttgcccctatcaaggttgattttcaaactagagtctgtcagttttctttactccattatcaagagcaagttaatgagatgggtagaccgattgccagatccagtgtggaaaatgatgtgtggctgctttatagattactgagcttctctaatggagtaagtttatgctactgtgttcaaatgatacaaacaggacctctaggaggttatgttttattgaatgtaagtgatttagatggctaaatctacatacctatagaatgcctgtgcactttacagttttttctgcttaagaatgcaagttatgttagagttttgtttataaaactcaggaaaaagtcagagatgtctttttgttgttgttgttgttacaagtttaaggtgagcactaagatctgaggcaggttataaaatagttgataggcatagaatgagcacagtctaatttctccttgcaggaatgaattatttgcaataatttgtgtatgtctttgtgaactcgttaaattctttgatttgttagaaagtcattatgtatctccaaggcacatttctttttctttctgtcaataatggtgtactaaagaatagaaaaaaaattctaattttaaaaaggctctttgccattctagtctctcaattattcaagcccttcttttcatttcttaaacctcttttgtgttacttttgagtcatttaaatgcttattagcacagagtgagcacaaaaagccaggaggaattgaattcaaatcagctttcctacctgtcaacaagtttgtcgagtaaagttttggctaaattgagttttggggtagaaagttcatgaaaattctatttatccatttgtaggtaatcaaggttatttgcataatatttgaactggctgtaatgaaaaatgtttgttaatagagtgtgcactaatcatatagtgcatagtcttgtttgtttcttattgtttttaaagtaaattctttgtaagtttttaaaagtagctcttgagtttttgtaaatagttaaatagacttggaaaggggaaataattcggcagttaaaacaatttcttccctatgctaaaactctaagggaaaaaatgggttttatttttccttaatgtttctatgttagatttaaaggccttcgaaatcatattgtgctgattcttagaacattaagttgttgttcctaaattaaagctgggaagtgaaaatttaattctgaaagcatcagcaacaacttgtccttctctccttgtgtgctgccattttagcttggaaggcatacgtgtaagagcagtctctttgtactatttagctggttatccctacacaaaaacttctggctttgtagttctcagggctctctgctaggttgtgtggaggatattgaggtgaattagacatggtcccttgacaatagcgtactgttgtttttttttgtaatttgattcttaaccacttgaaattgaatctgccaactcctttcccccaagtaaaagacctaaggtgctaatccctactcactgatgacaaatgctaaattggaagcaacagcttaggaatgcaaagatccttatccaattacattacaagctctctaagccagtcatgttcagcatcatcagggcgataggaaggcaagatctcactttggtaagaatgatagcgtagtttgagtaagttttagaaaattctaaaatgcaaagttcattcaaggaaataaaatgtggtaggagctgagaaaatgatttgcttttgttaagttcaacgcataaaggtttatgtggatcatggttaagagcactggcttgggagtccatcagataaagatttgaatcccagctccacaaatatgtgacactggacctgcctaagcctcaatttcctcatctgtaaaatgggcataataaaataacctctcacaggattttggggagaattagatgagatcatagatataaaacgcttaaccgagtatacagcaatgcttaatgtaagtggtaacagaaagtacaaggcactgtttgctgaccgaaccggtgtttttgatcctgcctaggagactaagtaaaccacccaaaaagcagttaagtatccagggaatgttatatatgagtaaatgccacaatagatgggaaagacaataagggctgttggggagcgaggagggctatgctatcataagaatcaggtgagctaagtgtgggttggtaataaacatgacccactggtctcatggaaagtatgacttttcccttagccgtttactttaagaaaggtcagtgtcctgaatgcagtttgtatttagattcttatgccaagattttccccagaaaataatctttatgaaaagatgttcatgtctattttggcaagttgggttctgctagttaaaaagatgcccctcccgccccaccacatcaccattagattgtagttatgcaaagctccttcagtaattggagttcctattggggaagagacaaagagatgagctgctgaaagatggtcacatttggaacaaacaggccatggtcataacaaagtcaaatactctttatttgaaccttatgaagaaatttcttacaggctggacacagtggctcatgccagcactttgggaggcttgatgggtggatcacttgacctcaggagtttgagaccagcctgggcaacacggcaaaaccccgtctctataaaaaatacaaaaattagcctgatgtggtggcacacatgtgtagtcccagctacttgggaggctgaggtgggaggattgcctgagcccagggaggttgaggctgcagtgagctgtgatcaaactactacactccatcctgggcgacagagtaagaccttgtctcaaaaaaaaaaaaatccttacagttatggttccattattgacatgctgtatagggttcctctctagaagtctctaatctacagtggtggcatctctcacttctgtgaatcataatgcaacttttgcttctcctcatattcacacaccactcttgacagttacctagtctctgatcttacagggtttatgaataaaactagaaggcaagatgaaatgatctgagaccacataaatcgatatgatgaaattcttctgattgatctaatggggaatagagggactcacacattttagtgtgcaaacacacttgtacagttccttttttggaagaagatatggctatcaaagggcatgatagatgcacagaaattacaatagtctgtgatcagctctcacatcttgggtttatctaccttccccacgagactgtgaacttctcaagggcaaggtctgtttttttattcacctctgcattaccaggggctagcacagggccagaacctcagtaggaactcaataaatgcatctttatgctgaactcactttgttttctgtgctgccggaaattgcatgcccccagtggccattttgagtgcaaagtgttattttaagatgctctctagagaaagcactctaggctctgcttacaaatgtctgagaggaaaggagagccgaatgactaggggatctggagaaattcctaagtgaaggtcgtggagaaatgatgggaaggagagactcacctctttttgagtgtgctacttctatcccaagactgttgttatttttcataagaaaatgctcagatgtcattgaggctgtagtctgactgcaatactgcaaaaaagcacttttgggctaatcattctctttctgaaaccagtagttgccatgttcctccttgtgctgaaactcagtttggaggatggggtggtggtagtggtggcgtggtggtgcagggatgtttttgaattggctctgtgccctactgctcagctttctgcctgctttctggtatccctcccagtgtgataaaggagagattctatgatgccagtgttcacttcagacttgcagaagagacattcttagaattcttaaggagaactagtttctaaagtaaaagatttaccggtaaactaatgacctttggtatggtatttaagcagaagtaacccaggctcattttgcattgcttacagataaatattatgtgattattcttgtgtcttacacatttctaatgataacataaatatgcctgctagtcaaatgtgcttttggatacatgagtggttggatggttgaatatatacattcatgtacatttttatgtattttagtattacaagcatggttttatatttatacacatacagttacgatgataaaagatcagtcatcctgtactgcgaatgtacaggaaccaccacaaaattgtaaagtctaagtggtgatgctattagtgaccctcagtgaggatccattgtttcctctctttggaccaagaagtggactgcaactgaatctattctgacgagtttccttttttgctatctgtcctttccacttatattagaaataaaattatctcaatttatggagctgtgcatttcttcccatttgtagagtttgcacatagaaagctcattgagatttggtccttagtggcctgagtaagcaacggaaaagtgtactgcatcccacaccatggtaccaaaattggcatttttattttactagagatagaaaaatgcaatttattctcctttatgggatgatatgaagctttctttttcaataaatgttttcaatgaagaagatatttgatttgaagaaaaatatgaagtaaatgataatacagatggtgtggcaaatatgaggattatatgtgaataagttcgggaaactaatagaaacaaggattaggagttgggagacctgggtttgaatcctggttcagctcctaatgtagacagatgaacttaggcctctgagccagtttcctgatggataaagttgaaatgatggtattttccttgtctacttgacaaagcgtttggtaacaaacagaatgcatatgaaagtgttttcttaagactgcaaagtgaccttgaaatgaattaacaaaaaatactaatattattagcaagttattcaagaaaacttaggagtcagtgaatgaaaacttttaagaacaaatcattttgttttgttttgttttccccatggtgaaaactgagttggttccaaatttaggttgacggttttcctgtcactacttacgggaagaagactgaaacatatgctcacttctctccagattgcataaatgccttcgccttttacttagcactgctccggaactgtatggaagttgctattatttgaatgtttaaggtaccatttattgtaacgggtttttggagttatgaaaaagcacctttgcaggccaatcagtgcacactggcagaaaggataaattacaaagctgaaagaaagaccctctttgagtgtattggaagcttttatgtataagtctaataatagaatgagaaagctgaatgagaaagttagataagggatatgatggagactgcagggcagaaccaccattaaatcatgataattctataggtcaaaaggttttctttgtctctgatgcctgcagagttataactgaatcctactagaagggaaatgcagggttcagtcccttctcatctttcttcttggagagatgaatcctgattcacaggcctaaatcttctattaggggaagctttgtgggacccagagtagccaccctaacttttccgcaattgagctacccctgacaaaaaaagtaggcgtgaagacccagaatgcttagtttaatcagttttaaatgaaaagtgaaactttgttttctataacataaatatatgtccttcaaaacatgtggtaagctgtgtttcatttttagaaggtatatacttttaaataaatgagtaattcaggaattggagaacattacgctaagtgaagtatgtcaggcaaagaaagacaaatactgcatgatctcacttatatgtgaaatctaaaacaatcaaactcatagaagcagggtagaatggtggttaccaggggctgggggcaaagtgggggagatggtagtcaatggtgggatacaaagtctcagttaaacaggaagaataagtttggtttttttgagatcaatagtatagcatgctgaatatgcctaataattgagtactgtacatcttatcactaagaataaatttctcatgttctcatcacaagaaatgttaaatatttgaggtgatagatataactagcttaatttcatcattctacattgtattaaaaatcataacaccactttgtaccccataaattaaaaaaataagtgattcattttgacatattctttccatattaatttggagctacattagaaagctgaaggagggccaggcatggtggctcatgcctgtaattccagtactttgggaggtcaaggcggggggatcacctgagctcaggagttcgagaccagcctggccaacatggtgaaaccctgtctctactaaaaatacaaagattagctgggtgtggtggcaggcacctgtaatcccacctactcgggaggctgaggcaggagaatcgcttgaacccaggaggtggaggttgcagtgagctgagatcacgccattgcactccagcctgggcaacaagagcaaaactccatctcaaaaaaaaaaaaaaaaaaaaaaaaaggaaaagaaaagaaaaaagaaagctgaaggaggattttcttttttttctttttcaaatatacttgaagtaggtacttgtaaaattattgtacagagaagttgacagattcaacaggttaaaacattgaaatttgaggactgtttttgcaatctgtactaggaaaatagttggcaccaaaagcaagacttagattatttttagtgcctcaagcttgctttcttagataggacttattcattcaacttctctgagaaattgatctcagactgtgagcgttagagctggaagatgcagtcagtttccttttgagtccatggaaacacggtagatatggccgaaaggggtcagatttttctgtcagaaaatctgaatttctcaaataggattttttccttttatttcaactcattttgcagtagtatttgcagacatgagagggatgatcaacttgctttgatctttgtagacatgggtctacaaatccaaatttaagacttgaaataaagcataaaggttaggatcttttagatttgttgaacactgagctcattggtcagagtagtttactttaatctttctaaataatcttctacaggaaactctgagatgcccttccgatatggaaattgggtatagctgtgacctgttgtgaaccatgtataaaaactattctcaacttttctatggatgtagtgatactagagactacctcaaatactatgtacaaaaatacaagtataatcccgatgctattataatattaagtcttaatataaattatatttggggtttttatacagtttttattataaaattttaaggaaataatttcatatgaaacatcatcattaaaaattactactgtctgcccaccttggtttagaatagagtgttgagacatggctctggttgaatctgaatatctcaaagttcatcagcaattaatgactggatgtctaccgtgtgccaggtattctaagtgctgggattaaagaagtaaacaaataaaagaaaatccctgccctcaaatagtcagagaggtgaaatagatggtatatcagattgtggtaagttcaatgaaggaaaaaaaatgataggaaggtaaatagtgggatcccattcccagttcagtaccatgcacatgagaatcttggtatatttctttctttttctttccgccccccgctcccccgcagttgcaggggtcaagggctggtggtgtgcatgcatgacagctgtgggtgcatgtacagtagtgatggccagtggtggaagtcagggtcacctcatatggctgtgggggttgaggcttatggcatgcacacctgtgacaatgaaaactagtgatgatagacattgaagtcagttgcatgtgtacacacagctgcagggtcagccatgggtgtgcagaagtgggtgccgtctttgtgtatttctgaggggaaaaagaaaagcagagcctttgcagtcacagacctgggtttgaattccagttctgaaggcaggcaagttacttaacctcagttaggtccagagtctctgcatctgtaaaatggggataatgattcaatctgtttcatattgctatgagtgttacatgaaaaaatgtacagaaagcgcttagcacagtgcctggcatatagaaagggctcagtaaatgtgaactgttaccactactcttattatgttacatcctggctttcttagcatcactgaccctgcttcttgttactttagcttcagtctgggtcctactgtcaatggccagctcgcctagaagtccagcagggatccactgactttgtcaccttgaacctaaccctttcataacctgcccaagggatcaagcatctctagtatctatgcctgccctggatatgctggaacttagtatgcccatgggacagtgtccctggtacagagtaggaacatgaatgttgatactttctcctccaacgttgcccagagagtagtacagatgcagtaaataccaacaggcacacttccaagtatgccactttttgttttacttaaaattcaataatttttagaaggcacacagattaagtagaataacacagttctatttctccagaactttttttttttttttggagagacaggatcttgctctgttgcccagatataagtggcacaatcacggatcactacaacctcaacctcccaggctcaagtgatcctcctgcctcagcctcccgagtggctgggactacaggcatgggctatcacacccagctaatttttgtactttttgttgagatggggttttctcatgttgcccaggctgatctctaattcctgggctcaagtcatccaccttcctcagcctcccaaagtactgggattacaggcatgagccaccatgcccagccagaactctttatctttagcaagagaatgtctgtgtgtgtgtgtgtgtgtttgtgtgtgtgtgtgtgtgtgtgtgtatgtgtttgtggtgtgtgtctagctatgaagactatttctcttgtgaaactgtctcaattaagtacttaaaagtatcagtaatcccttcctttgagaagtaatgtatctttagtacatagaaagttatttaactcttgtgagtttgatcataataactttacttttgtctcttataaaggaaaaggccaaagttgttgagcccctggactatgagaatgttattgcccaaagaaaaacccagatttacagcgaccccctccgagatctgcttatgttcccaatggaagatatatctgtgagttcacaaacacttctttaaagaaaaaaacccctatttttcaagccagttcttacagcaaaaatgttctttgtgttctagatctcggtgataggtcgtcaacgcagaacggtgcagtctactgtaccagaagatgctgaaaagagggcccagagtttatttgttaaagaggtaagaggctcaaaggccacagaagaatattcttcatatatttaaaatatatacagtatttatatgtctttatgtatttgtaacctgtttataaatacataaatgtaaaatatttaaagtagtcttcctttaatgtaaaggtaaaataaaataactaacattaactgtcctaaataacaagtttatatgctgttaacaagtctatatgatgataaagcttaaacatttccacaaggtgcatatgaccttagtgttttccttttggatttgaatactctttgcactgagagtcagagtattcaaagggcatatgaattgggatttattgccaccaactgggtaagagagacacagttaacccataaaggaagatcccagtactagtaattgccaaatggttttagaaagcctgtcggcatagtaccagagttttaaaaagtggatatatatgtacttttcctatatttcaaattcaagattcctattttctttcagtgtattaaaacctatagcacagattggcacgtggtaaactacaagtatgaggacttctctggggactttcgaatgttgccatggtaagtttagcattccagggaaacatgcaacaggag[145 bp omitted]cctgtctctactaaaaatacaaaaaattagccgggcgtggtggcaggcgcctgtagtctcagctacttgggagggtgaggcaggacaatgttgtaaacccgggaggcggaggttgcagtgagcggagatcatgccatcacactccagcttgggcgacagatagagactccatctcaaaacaaacaaacaccacttgtgaaacctttcagttataatttgtaataaagcaaatcttcaaggaacctgcatgtttggttaaatgcagtgttttggttaattgaataggttttaactttcctctttgaaattccaaaatgtatgagagctcactttttggctttagtgaacctgtattgatcataaactaaaatatagctgatgatggataatgtagtgagcattttccagtagtgtcagtgaaaaagcttgatgataattagttcagtttgatgaacctagccatcccttggaaaaagtgcatctctttcagttgaattgaaggaatggcatgagcacactggcccaggagccagactgttggggctcaaatcttatttctaccacttactagctggatgaccatggctcagtcacttaacctgtttgagctctccattttctcatctctagcactaattcctcacaggatgtcatatgggaaatgtttttggaacaaatagcagaggaataagacatttgtttagccttttgtagttttcagagcactttccaaaagaggagaaaactgagtcctatatgacagcctggtccttgggaaaaaaaaagaaaaagaaaaagaaaacagagtcctaaaatgaccagtccaag[135 bp omitted]gcaacctctgcctcccgggttcaggtgattcttctgcctcagcctcctgagtagctgggcttacaggcacccgccatcacccccagttaattttttttttttttttaatttttggtagagacggggtttcacccttttggccaggctggtcttgaactcctgacctcaggtgatccacccgcctctgcctcccaaagtgttgggattacaggtttgagccaccacgcctggcctgtgttgctttttgacccggggaaggagaagttctgccaccactaacagctctggcacaggttccttagcaacttctgccctccctaagtttctgggcttagttatgtcttcgctgctggccacatatgtggaagtccttacagaaacacaaacttacagtaagtttactcagaggggataatctgaatttggaaaggagaataggatgtcttggcattttctcgtttgtgaaagaaagaaatctgctcatcttgcttttactgttgttgtcattattgttgtgtttttgtgttgtttttctttttttttttggtctttttagtgtctaagacagttctcttatatttgcagtaaatctttgagaccagaaaagattcctaatcatgtatttgagatagatgaagactgtgagaaagatgaggtaagaatgggggcaacagttggggtaactgtgctagtttcctcacggtcactttgctgaaaaagatttcaaagggaatttcttgagaaaatatgaaggaaataattattctggaatgatctgtggccagctttcaaaccgggtgcttttcaattttttttttaattactgtatttccaagtagggtttaggaaaaaaaatcaagtgagaggggctatgatttgtacataaacatgttcccccacctgtgggacatgcttgtggagttgcttttcttgagttgggcatgtggtgtggtgattcatctggactctcctgcctgatagattcctcttgggacagatggcccggatgtctgtgacatttcgaggtgcagttcgactgtttacataatgcagaagatttcccagaagagagcccataccattcagtaaatactgagtgcctactgtgtgcatagcacagagcctttcattctacagtcaactattttaaatcctcacggggaagaggggactttatgttttaattaggaaatgggcagggcctcattctgtgcccctaaatgtttcgctaattagatggcaggctggctgttgttttactgataatttttgttctatttcaggactcatcttctttatgttctcagaagggtggtgtgataaaacaaggctggttgcataaagcaaatgtaaatagtaccatcacagtaaccatgaaggtaggaagtagttattatattattccatcattttaatgatattggcataagtagtctatctggaaacaatatttattttacaaagagccctagcaaaaaaaaaaaaaaaaaaaaaggagaggattctcacagacgtatggaatttaaaaaatctaaaacatcaggataaatttagaagtgcaactttttaaagacatataatgtaatgattatctggtgaatcaggatgtttaaaaaggaggctgtcagttgaaggaggaaaatagctttgaaaaatgggcatcaaagtttcatatgtagaaatgaccttaatgagtggaaggacaagtaatccatttctttagcaaatattaattaggtacttattacatattagtcactgtggggaaatatgtagatatctaagatgtggtccttggtctcagcctctagactagacaagaaatatactattttaactagtatacaaagcagtcctttagtgcagtgagaacagtctaactagaaagttttgtagtttgacaggatagtgagtttgcataaggggtttaagtgagctaaaagttgaaacgttgaaaaggataaaattgggctgggtgcagtagctcacacctgtagtccctccttctttgggaggccgaggtgggtggattgcttgagggcaggagttcgagaccagcctgtgcaacatgatgaaaccccatctctacaaaaactacaaaaattagcctggcgtgatagcacacacctgtagtcccagctactcaggagactgaggtgggagaatcccttgatcccaggagatggaggttgcagtgagccaagatggcactactgcattccagcctgggcaacagagggagagtgtatctcaaaaataaatagataattttttttttttttacaaaaaaggataaaattgtgcagagccttgaacaccttggacatgaggttcacttatttgggaggctgtaaagagccattaaaatccaaagggaaaacaagctacatgaggattctgagcagaaaaacaaattatgctctgataccaaatataactgttctttcagatattcaatataaaatcatgtggttttctgaggatgattcacacttgcattaagtattgaaggtcattctatctttcacacaggctgcaagtagaaaccgtgggtatctaccaagggaagactcaaattttatcttaatttaatattttgcctgctgccttccctttggtgatcatgtcctgttctcactttcattttcaagccctgaaaataatgaatccaagttgtaggatacttcctgtatatcgcttgcacctaagcatgggcatcagcaagtggtgataataagagaaaccatttattaaggacttaatacgtaccagacaccatactgggtgttttatattctgtatcttgtttaattctcatggctgccctatgcaataggtactgctaactattcttagtttatagatttggaaagtgaagctcagagaaattcaataattaacccaaggtcccacagctccaagttttcagaggtaggatttgaacctaggcaggctgatgtcagagcctatgctcttaaccagtatactatcagtgctcactagctgaatgagactcaagggtttattaacaatatatttcgtgccagagttatcaggttcagaaatgtacgtgaaggttacatttctgtgtggattatcagaaaatggttgtatcgtttttgactgcattccctttcccgcagattctcaaaatattcaaatagggccaggcaggaggctcatacctgtaatcccagcactttgggaggccaaggcaggaggatcgcttgagcccaggagttcgaggctgcagtgagctatgatcacaccactgcactccagcctgggcaacagaattagatgctgtctctaaattaaataaataaatgcatgaaggaatgaatggttttaaccacatttaagccttagcctcacattaagtaaatgtgcaaaaatctggattcataaaataagatgttaggaaattaatatctttacagaataattcgccacagattcctttagtttaatacctttcaactttaatttgccttacaaacaacttctaattttgtaggagtccatatattataagccaaaaagcacatgctttacattttctctcataatttgtgaaatacacattgattgattgatgtgataggaggaattgatggcctctcaaagatgtccatgtcttaatccctggaaccagtcaatggtcccctacatggcaaagaggaattaaaattactaatcggcaggagggacggtatccacaattatgcgggtgggcccagtgcaatttcaagaaccccataagtggaagagggaggcagaaaaggacagtcagggaaagagatgtaaggatagtcagggaaagagatgtgagaacagaaggagggccagagagagatgctgtcttgctggctttgagggtacagaaaagactcacaggccgagaaatgcaggcagcttctagaagccggaaaaggtaagaaaatggattctcccatgcagcatccagaaaggaacatagccctgctgacaccttgaatttagcccagtgagacccatgtcagacttctaacctgcgaaactataagataataaatttgtgctattttaagccatcaaatttgtgctaatttattacaacagcaataggaaactaatacaattagttaggcaaaggttgattgttcagcttgtgtgtttcttatccctgagcttggaaactctagcactaacagtgaccaggcgggagccataaattcatagagtgtgtgatgggtccgaggcaacctggtgaccacatagcccacagctgaaggggacagctgccacttgtctccagctaattgttgttttgctgcagctgagctaggctctttgctttgcctctttttatcctcagctgctcatattctgtgtgtgtgtgtgtgtgtgtgtgatcattaacatataaaactttttttttttttgagatggctcctagctctgttgcaccaggatggagtgcagaggtgcaatctcagctcactgcaacctccacctcccgggtttaagccattctcctgcctcagcctcctgtgtagctgggattacaggtgcacgccaccatgcctggctaatttttgtatttttattagagacggggtctcaccatgtggccaggctcgtctcgaactcctgatctcaagtgatccacctacctcagcctcccaaagtgctgggattacaggtgtgagccactgtgctcggcctatttctttctttttaaaatctctaccaaacatcaggcaaaggaaggaaaagaggaataaaccaagttaattggtcatatgaagctacacaacttttatgtttatttttatcatttatttatttgtttttgagacagtctcactgtgtcgcccaggctggagtgcagtggcgtgatcacggctcactgcagtctcaaactcccaggctcaagcagtcctcccacttcagcctcccaagtagctgggaccacaggcacatagcaccgtgcccagctaattttgtttgtttgtttgtttgtttttgatagagatggggtctccctatgttgtgcaggctggtctcaaactcttggactcaagtgatcctcccaccttgtcctcccaaaattctgagattacaggcatcagccaccatgcctggctactacacagcttaaaaaaagttaataggaaatactttgaaatgcaaaggccatattgaggtttgggagctgtttctggttatgagtttcctttatccccactcttttccattataaattatgaatctccattttgaatttcaaactcttctgatttcatctcctgagccatagcagtagtgttgtatttcagaatttgtcacagctagaatgggaatcagaggaaggttcagctagaaccttctgaggcattttgccaagattactttttcctctaataattgtattttgggccaggcgtggtagttcatgcctataatcccagcagtttgggaagccaatatgggaggatcacttgaacccaggagtttaagaccagcctaggcaacatagcgagaccctgtctctacaaaaatgaacaaaattagccatgtgaattggtgctcccctgtagtcccaggtacttgggacattgaagtaggaggatcacttcagcctgggaggtcgaggctgtagtgaggcgagattgagccactgcactccagcctgggtgacagagtgacaccttatctcaaaaaaaaaaagtgttttaactgttatttagttcaacattattgaaattagttggaactgcagtgttgacacatcattttttcatgttctctttctgtatcaatacagggcaagtgagtgtatggggcagaggattgaaaagggggagcagttttatagtttccaggctagaacttgaagtgaaggccaaagcacaagtccaggcctatgaacaaaggcacactgggagagtctggtttgtacctttcagtgctctgttacagggtgggggatcatataagttcttcctgcatcacgtctggattgtttcaggcataggaggctaaagctaaagatgaggtgagcagctgacccagctcttggataattggaaaaggcagaggcagaagaactgagacaaagggttgacagagtttgagaggaaagtttctatgtattttttttctactatggtaatgtttgaagtgaagaatactaatgaagctcataagcaaatgggaagatgactcaggtgtgctattatctgagtcatttccccaatcctggaggcaggtttatccttagagcatctggagttccctgcccgctaggaactccagcccacactggtaagaagcattggtagatttagcaaccagcacctcagggccagagcttgcagagttgagagcaaagaatcttttctttttggaaaatccaagcttcgatagcccctgcaaactcatggcaaactaactaggaagcaagagcagatctggttattaaccatgactcagtggcaaataacagcctccataagccaagcttcttccctgtgttttagctgagcttatttgatgccctgtggcttgacactggcctgcagttccctctggaattgctagggaataaaagcaaggcatcttggtgccttttagagagaggtgtacgtttaagcgtctttattcattaagaaatttctaaattttaaaaattatgtgctgggcatagtggctcatgcctgtaatcttagcactttgggaggccaaggcaggaagatggcttgagtttgggagttcgaaactagcctgggcaacatagcgagccctgtctcttcaaaaaataaaaaaattagctgggcatggtgacgcatgcctgtatttgcagctacttgagaagctgaggtgggaggatcgcttgagcctgggaggtcaaagctacagtgagctgtgattgcatgactgtactccagtctgactgacagagcaatactcgatctcttaaaaaaaaaattacagtcagttctttggaaagtttgaaattatgcgcaactttaaactgatcttagaaataggtctgagttgttttgctggacattttgactgttagaaataaaggaatctgcccaggcgttcatgaccagcctgagcaacatgacgaaacctcgcctctacaaaaaatacaaaggtagttagctaggcgtggtggtgcactcctatagtcccagctactctggaggcttaagtgggaggatcacctgagtttaagaggtggaggttgcagtgagccaagattgtgccactgcactccagcctgggtgacagagcgacactctgtctcaaaaaaaaaaaaaaagggagggagggaggactctaatagcaaggaagggaggaatcacatcgtgagagaaagtgcaaaaataaaacgaaggaaagagtattagaagagactcagcaaagtgcagttgataaaagggaattagaagattccaactttataagatcttttgagaaagcaaccacatggcctttaatgcaatctaaataatatagccaaactaatttgtatatgggttgctgtagacagtttaaccttcctagctagcttgccagcaagttttgcaagaacattcaagtcgacagttcttgcaatgacttgcagtgcattcaagtcgatgggctgtagggaaaagaggggctagtagaggaactaggctgagttcttcgtattggaagattataagaccacatatttataggataaaaatttatattttccccaatatatagctttccccctgctctggtcagttgttaagatataatctgtaccaccttctgaaatgggcatattttcccagaagtgcttgctgagtataacctcattgttggctgagaaacttgccctgaggagcctggactacaggaaagctgcgaataatgtgcatcactccacgagtcacagtgctctgtgcccaagcacttcctctcactgaagaggatgcatcatgcagttcttgcagaagctctgttgtactgggtgtggtggcatgtgcctgtaatcccagcaacttaagaggctgagtcaggaggatcgcttgagcccaggagtttgaagctgcagtgagctatgattgtgccactgcactccagcctgagcacaaagcgagacctcatccccttttttttttcaaaaagaaaaccccaaaaaacaaaaaaccaacgctctgttggttgtttgggtgcagtgaacatttagcacttgtaatttgctttgttcttggtattcaagttaaaacaggacaagccttatcatagtgattaatttcgtcaatttgtggtttctagttaatgaggaggtaccttgctgccactcttcaattcctggaaaagtattagagagaagttttaagatgtcatagagaatacatgatcctttagacagaaaccacaatcctaacagacccctattcatttacattctctctttcccaagtagctgctagagacatctgctttattcaacttcttttcatatcaatgaaggaatttaatgtgggtttagatagctgtgatattggacatagccttcccctggtatttagaactatttctcctaagagatataatgatatatggaggaatttaatcttcagggtggtttttcattttttaaaaaattgctgcagattcttggccaactcctgggacacccacctttatgcatctttttggctcaatttggtcacattcctctagctctctcctccccattctcagcaattaaacgctgaagtgccttgatatgatatcggggttgcaagttcaactggttgatgtatgactcacttctagtgccctttaaaatttttttggcacaaaaagagccatttgttatatatccagagtccaaaagtccttaaatccttaactcttccaggagggatttttcctcctctgcagtgggagaacatcaaatcaaatgaggatttgacctaagaaagcacatacaatattaaaataattgctaggaggtcaaggtcactatgtgtgttagaacaaaaggaagagaaaatattttatttttgatatcttagtccaattgtattctcaaatctaccagactatctcttacagctaacaaatggattgcattcatttattatgcataagattttttcattaatttgttttttatgttttgttttctctcattcatattacttctcaaaaactatttattaggtgcttcatatgtgtcagacactattgggtatcaacaaattcatgaccaaatagataatttcttaatttaattttttcagagacaaggtcttactatattgccctggctggagtgcagtggcacaatcatagctcattgcagcctccaacacctgggctgaagcgatcctcttgcctcaggctcccaagtacctgagactacaggtgcatcccaccacgcctggctaccaaatagatattgaatgccttgttaatacaaggtattagcattgtggagggtagagagaagtgtcagatgtagagcttaaaacctttttgggaaggtgggctgggcacagtggctcacacttgtaatcccagcactttgggaggctgaggtgggctgataacttgaagtcaaaagttcaagaccagcctggccaacatagtgaaaccctgtctctactaaaaatacaaaaattagccaggcgtcgtggtgtgcacctgtaatatcagctactcgggaggctgaggcaccagaatctctcgaacccgagaggcagaggttgcagtgagctgagatcgcaccactgcactccagcctgggcaacagagtgagactctgtctcaaaaaaacaaaacaaaacaaaaaaccacctttttggggaggtgagacacacaataaaaataattgtttaaagatggtacagtgaccaagtgctacatgaatctagatcattgtggcctggggtcagagaaggcttcttgaagaaggcggggcctcgaaggaagtgaatcagaaaggagaaagtgagtgtgccaggcaatatgtataaggcagaatggttaggtgaagctcagtagtcatgggagatgaagttgatttggttctttggtatcaccttgtgcctccatttctcttctgtaatatggagggcataacagtaatgaccacataaattgttactaggattcaatgaaataatacaaggaaagcacttaaccagagaccataatgcacaaagcaccccacagatgttagcaattgttgttattttatattattaggattgtgggagggccttgaatgcagtatctggcatgtgtgccttatgtgagtaattgagagtcattgattatttgagcagtgacatgctgtgctgaaatacatctgataaaataatttgtctgtaatgagaagggtggattgtagacccctcctactagacttggctttaaatcaaatagttgaactcttcagtgcccagatacggtagaattatttaagaaaagctatttgatttttactcagtttctcagtgggtaggagagtgtcatatattaaaacttggggccaggtgtggtggctcatgcctgtaatgccagcactttgggaggccaagccagaaggatcacttgaggtcaggagttcgagaccagcctgggcaacacggtgaaaccctgtctccactaaaaagacaaaaagcttagccgggtatggtgacacacacctatagtcccacccacttgagaggctgaggtgggaggatcgcttgaacccaggaggctgaggttgcagtgagctgagatcgtgccactgcactccaccctgggcgacagagtgagacttcatcttgaaaagaaaaaaaaaaaacaaaataaacttgataggactgtaaatgacatgatggagagaggtgagtgatatatcaggttgccaacgtagtggtaggggttctttagcaggatgaagttcctggcattctggtgtcattactgcaactcacttttctaagtcctgtggtttttttccccattgtttctttcatttttgtgcagaacagttctaagacccagtatgtctctgtctctcctgctttctccttttccttgctggctcttccattgtgttctgtctgagacattaggcaagttcccctacatcatttctacattgctcttggcctacctactctgcctctaaacctttgatgtatcctttctaagggcttctggttcatgcaatttagcagtaaataattacccctctaggtaacacacaataggtaaacgctcttgggatttgctgtataaaatgataaaaggttttcctactttcttttctttcttttttttttttttgacagaggatctcgctctgtcttccaggctggagtgcagtggtacaatctctgctcactgcaacctctgcctcctgggttcaagcacttctccagcctcagcctctcaagtagctgggattacaggtgtgcaccaccacgcccagctaatttttgtatttttagcagagatggggtttcaccatgttggccaggctggtctcgaactcctgacctcaggtgatccacccgcctcggcatcccaaagtactgggattacagatgtgagccgccacccccagccattttcctactttgaggatactaagtgctccaactttccttcctatgtttaatctttgatgcagctgaatgacaaaaggcctttgttcctgctccagaaggggttcaaaaaggttgtcatctggccaggcacggtagctcacacctgtaatcccaacactttgggagggtgaggtgggtagatcacttgaggccagaagttcaagaccagcctggccaacatggtgaaaccccatctctactaaaaataaaaataaaaaaaaattagccaggcgtggtggcatgcacctgtaatcccagctactcgggaggctgaggcaggagaattgcttgaatccgggaggcagaggttgcagtaagccgagatcacaccactgcactacagcctgggcaacagagcgtggctctgtctccggaaaaaaaaaaaaaaaaaagtgtgtcattccaacagcttggggccttaagcacacttggcaggacctgatcctatagaatcaaatcctttggcttgctctctgttttattgttgtgggtggtctgaatgggccactcttcaggatctgtgttcctcactgagtaaggtggggcattttcagctgtgttcaccatcaaacaaaaataataaagacgaggaggaggagaaagaagagtgtgggcattacagagaaacacaattctgttgtatgaaaccactggagaatctgctggagaatctttgctggaaatgggattattcattcattgtttattaattttgaaacattttattgagtccaggcattgttataggtactggggggttaacagcagtagatgaaacatgaaacttcatgggctagaaagagacggcaaataaaacagatagatgaataacatatttgtatagggatcactccatgaaaaagacataactgggtgctatgatgagggcaggtggtacagaaggcctcccagaggaggggagattgaagcaaagacgtgaaaggagtaagaaagtaaactgtgtggatagtgaggaaagaggattctaggctgaggaaacaggaagtacagagacccaaaggagcttacttgagatatttgagtaacagcagataagccagtgtagctggagcagaaagattagaaatagagtccaaggaaggccgggcgcggtggctcatgcctgtaatcccaacactttggga[134 bp omitted]gaggccggagaatggcgtgaacccaggaggtggagc[138 bp omitted]ttttctgggctatggtgaggattttagatcttactgtaaagtaagatgggaagccattggaggatttgggcaagattctctttgtagccattatcctattctgattccagttctatcagtgacttgcctgtgtgaaccttttttttttttttttgagacggagtcttgctgtctcgcccaggctggagtgcagtggtgtgatctcggctcactgcagcctccgcctcccgggtacaagtaattctcacctcagcctcccgagttgctgggattacaggggtgcgccaccacgcctggctaatttttgcatttttaatagagacacggtttcaccatgttggccaggctggtcttgaacttctgacttcagatgtttcacccacctcggcctcccaaagtgttgggattagaggcatgaaccaccgctcctggccgcctgtgtgaatttgaatgagctcttgatccctcagtttgctgttaggtaaaatgtggataatgatacttaccccaagaggcattaaaagaattagctattggttacaaaaggctcgcagccttcaaatgacaggtatgatatagagtaattaccattattctgtatagtcgttattttaacacctgtcttcttttagaaatgtaaaaaatatatataaacttataccctaagtagctgcattgtggaaattttttaaatgtctaggaagttatgtttctgatttccctttgatttccatgagagagatttaggatattcctttcttctttgcaaaagatatcttaaaagcttctcagaagttgaaacccaacatatatcataaaatattagaatgagaagagaccttacaatttgttgttgggcagagtctgatttctacatagagatgacttttaaaaatattccttactgtccaaactgtgtgtttctagtgtatgagaaatcacatggggagagtagcttccaggctaggaaggctgctgtgttatttgttcaagttgaatgaaattatttgtagattgtggaaaaatatgatcttacagatcatctcgtctgatgtcatcattttacaagtgagtaaactgagagaagcagagtcttgaggacaatttcactgctggttagcaggagatactggctgagaatcagtatcataagactttcaggcaactgctctttctgagtgctctttcaggcatcatattctctcctcagattcataagctacctaccctagtgtcacatttagatataattgcaatgttagaggaagtgatttgctgtaatttcatatccctttccatgtccattgtaatgatgcactttgctaatatgggaagtggtggctgccacagaatttctttgcttggtgaggcagctgtatgtgaaaaaaaaatttctcagactataatttgactgtatgccacaaatgttttgctctgtattttctcttcttctgcctctctctttgttgctggctgttgactctgcaagtggattctgtaggctgtcccactgaagcagcagaatttcagttttagatttgaacaattcaaatataaattttttcatattatttttttcatgttacttttggcctgaaagatgtattctagttttgttatagataattactgtgataactttaaaaagcaatgtgttatacaaagttagtgttcattacatgttattcatttgaaatgacctcagcatgtaattttaagccttctattcccatcattttaatgagagatgtgaaccattgtcatgaaaataagcaaataggccaggcagggtggctcacttttgggaggctgaggcagaaggatcccttgagctcaggagttcgagaccagcatgggcaacatagggagaccttgtgtctactaaaaataaaaataaaaataaagaaaataagcaaacatgcatatataatcaccattatgattaacattttcctttaatattaatctagatttcttccagcaaacttaaatgtagattaattgaatatgagaatatatgtatatattctcacatatatgagatatgtacatatatgaaagatataaatatacccacacattctctttctgttcctttgcatactaatacaataacatttaattgactggcattgcaaaacaagctgatgttttctgctaggactcttttctgttgatagcacgtagcccacatggccccttcccgagatagaagctgtagcatttatcagtctaacctgttagggtattccttacactgatatatatttttgtcattcattaaaaaaaatcaatgatatttatacaagtcaaaaataaatatcaatgttatttatttttactggtttttctaaaaagaaatgtcccttaaggcttttatatattttgcttggtcatgctatggagaaataaattgatgtttcaggtactttgccagacgttaagttgttggcaagaacgatcttgccaaataatactctttccataattaaagttctcaaaatgatcagggatcatattggataatcagatgggtaattaaaaatgaccagcttaaattttaaagccaggttcttcgaataagacaagatgcataggaatgcatttcctcaataatcaccaggagctgctcttcccatctcaccctgaagtgacttcagatctgtcatcctgggaaattgcaacttgaataagctctgcctttcactgtgacaattgcttgacatagcctgcagtttgtgacttactgaaagaagcatcaattcatcagagagctcctaatcccttttctcacctcttttatcagactgtcaaagtctgtttttaggggagaatagagggacagcatgaactcatcaggcagtccccaaccttttcctgttcctgtgggctttgctgtgagttgtagcaacaggctactccttaactattgtgaatccctaactccaaacaaatggcatagttccattaggcctgttgatttaaagctcagcacttggggcactcgacaacaactggcaggcaactaatgactctgtgcttccctgtgagtgccctgtaaattggactttcagaagcaaagacagtggtacagtgtagatgagtacatgtgtaggtgagatggaaatatgtaatgtgggtatatgtatatatgtatatatatgctttttatgtttattcttggattcgtggtaatagaaaccaaattaaaatgatgtaatcatggtttgcaattaaatgggaaaagaatgctatagtgaaagggtcaggagattcagatatcagaatgctttatacatttcaaagtgttaagtcttaattattgttctctagatatttgattaactgagggtaaatcatgtgattttcattcactatcttagaaaaatgaagataatgataattcctaacatcttgtcagggttgtctgaagattgtccaggcacaattgcctggcaagcttttgaggtttttagttcagagaaactattcaaatgcaatgtatatgtaacaaatgtatcattgctgggttttccccatgtaggtattcaagagacgatatttttacttgacccaacttcctgacggttcatatattctcaattcctataaagatgagaaaaattcaaaagaatcgaaaggttgcatctacttggacgcctgcattgatgttgttcaggtaaggccattgaggtaatccttctctttttctaacagggttattgataaacttttaagaaccccagatggttgggtggggtggcttatgcctgtaatcccagcactttgagaggctgaggcaggaggatcgcttgagcctaggagtacatcagcctgggcaacaaagagaccccatctctacaaaaaaatacaaaaattacccaggcatggtggcacattcctgtggtcccagctactctggaggctgaagtgggaggatcacttgagtctaggaggttgaagctgcagtgagctgtgattgcaccactgcactccagcctgggtgacagagcaagaccctgtctacaaaaaagaaaagaaaaagtgactggtgcggtggctcatgtgtataatccctgcgctttgtaaggctg[134 bp omitted]gaggcaggagaatcgcttgaacccaggagtcagaggttgcagtgagccaagacggtgccactacactgcagcctgggtgatggagtgagactccatcacaaaaaaaaaaaaaggaaagaaaatgaaccttggcatttttccatcttgattgatggcatctccgtcctccgaaacatctacactagaaagctcagaatcctcttcagtgccctgttcttgctcagtgccaatatttaaatgtttatcaagtctctttgagtctggctctaaagtgcctcttaacctcttacctcctactttcattgccctttctccagttctcccttttatcatcgctggcccaaagttgcgcttttatgcctcctgatttcttgtcttgctccagttcaacttcctaagatatagtttgggtcaatcatttgccttctccaaatcttttggctcttgatttattgtcttacagagtgaactctaaagcttttgccctgacattgaaggcccatagtgatttggcctcactgtgctttctagcctcatccttcctgaacccccttgtgtattctgtgctctggtcacaccaggctaagcattctaaagcgttgcacacatatatggcttgccttacatttttttcctcttcttgctatatataatttctccttctattcccgtttgaaccttatcttttatgactcagcttaaaggctactgccgtgaaaagttttgtgtttccttcctcaccctcgtgactaccaagtagaattaagctccacctctcctgtgctaaccattttgcttttccttctgtcatacaactaagtcacattctaattttggttaattctacacattcctttggggattacagggaccatctcttactcatttctgtttcttctataattaccagggttctgcacacagtagggacttaatgaatgtttgttgatatgaattactgaggggacacagacagaaacaggatgggaagtagagggctgagagatgatctggatgggaagtcaattgactatggaacagaagtcattattacagagccagggtggtgtggtggactagaagaacaatgggctgattaggaggaaagtgatgttagttcagcaccctcagtttacctaaatcttcattttcagaactgtgaagtgggattagtagtatctgtatactctatcaaacaagattgttgtgaggatcaaatgagaaaatacctttagggcatgatgttgtgtgcctgtagtgccagctactcaggagcctgtggcaggagcattgcttgggcccaggagtttgacgctgcagtgagatatgatcacgcctgtggaattagccagtgcactccagcctgggcagcacagtgagatctcatctctaaaaagataaattaaaaaattctaacaaatgagaaaacactttttaaaaagtataaagctctatgtgaataaaatgtgcttatatgtatgattatatattatatattcatatatatgaattcatatatattcatatatataaagaagagctttcttactggaagaacgaggcacacacaatttccggattgacctttctttgtagtgcttccctcatctttttatttttattatcatttaaaaaatttttttcttttcttttttttttttgagacagagtctcactatgttgcccaggctggagtgcagtggcgcaatctcagcttgctgcaacctccaccttctgggttcaggcgattctcctgcctagagtagctgggattagaggcacccgccaccatgcctggctaatttttgtatttttagtagagatgttgtataactttctccttagttcagttaaaaccagttcttgtcacataaccaggaaagattaggcttgtggacacatagaagggtgagaagtggaatttactgggtgaaaaggaaaaataactctcaccaaagtgagagagagtcctgctagcaggtttcccacctcacagattaaaggttttgccgggaatccttggctgtctcctgtctctgtcagagatggggtttctgcatgttggccaggctggtctcaaattcctgacctcaagtgatccgctcacctcagccacccaaagtgctgggattacaggcgtgagccgccatgctcaggcacctcatctatttatgataccgcctcccaaatattttcaaatgtataaatctttatgacttgatacagcagtttaatttcatcctttcgtagacttcaaagattagaaggaggaactttcttggttccttcttgaataatgaccatgcagtggaaaattattgattcatgagcatttcttgaaattaatgctgagggatttgaaaagggtagtatgtcatttcttttttcatgacagagaaggtggtaaagtaaaagaatgtatcagcaagcttgagaaaaggaggagacttattttccttgtgtggtggtattcagcacaggttacttccatgtattttatggagagtcacaatttaatgtgaaccaactatggttgcatggtcttattttttctttcttttttaccaagccattcttcttcttctttgcttgcttgctagctttctttctttctttctctttctttctttctgtttctttctctttctctctctctctttctctctttcgttctttccttctttcccttccttccttccttctttctttctttccttctttggagtcttgccctgtctggagtgcagtggcatgatcatatctcactgcagccttgcagccttgaactccttgctgcaggcaatccaccttagcctccaaagtgctgggattacatgcataaaccaccatgctggggcttctctttttaatttttaattttttttttgaggcaggatctcactgtgtcgccccggctggagtgtagtagtaccatcttggctcactgcacccttgaactccaaggcttaggtgatcctcccacctcagccccacgagtagctgggactacagccatgcgccatcacgcctggctatttttttttgtattttttttgtagagatgaggtttcaccgctttgctcaggctggtctcaaactcctgggcttaagcaatccgcccacctctgtctcccaaagtgctaggactacaggtgtgggccactgcccccatctttacttttttgttgctatggatatggaatatttctacatattttgggggtacatgtgatagtttgatacaagtatacaatgtgcaaatgatcgaatcagagtaattgggttatccatcacctcaagtgtgtatcatttaattgtgttaggaacattccaaatccactcttctagttatgttgaaatatacaataaattattgttaactatggtcgccctattgtgctgccaaacactgtggtcttcttttatactattgtgatacagttgatactatgcgtggtaaaatgagttaggatctatagtgccttttatggtgagatataaatttatcagatttgtttcaggtcatatttaaattttttaaagtgctgactttgaaaatccttaaatattcaaggaaaagtttgaacggagtggaaattctaaaatgtttgcttacttttatggtggtactttgattttctgaatgtgaaggatgccaaaaggccttaaatgataatacttaacaagtattgttttctcccaactttatacatattcatactactgtgctcagtcctgagggaggggaacaaaaaatatatttaacatggtcatttgttgtcttagagtgtctgtttcttactgaaagaagcagttatttcatgaaagtcttgacgcacatatgcactaagctgagataaaaataaatataaactaatgaaatctaatagtaaaaggacaactaaactaactgaacacatactttttctcccctctagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaaggtcagaattttaaagtgatttattattgaagtaaagcccttgtctttaatccgtggaaatgtcctctgtgcagggtgagtagagaactcttaatcttaaaagttgacctgcttcttcattaataagtgactgtggaggttgatagactttttttaaacagttgatgctgcatgggctctgacatatgaaatataaccagactaaaacagatagaaaattcatggcaggttttcaaaagtccattaaagttttccctatgctttcataatagaaattctttgcaataaatcttgtaggagaggatgggtgggagagatagttaggatactcctcttaggttattagtaatggtctgtatggtttagaacatctgcttttaatgaatttgcagatgatgaaactagcagccaaggaaaagccgagaacatcatggcaagtttggaaaggagcatgcatccggaactgatgaaggtacatctttcatatggcaacttgccttcaactgagataatgcaggattagctattaaagttttaatgctggattccatttggcaatgtcatttccacgttaaaaaccacagcaaattggtgaaacaggtagagattgtaaaagaaaagttgcactcctgaagactaacttgtaagtaccaactgacagtttggaaaaatcttatttttttccagacaccaagaaatacttccaggcttttgtgacttcattaattttatctgctagttcttatttaatttaattactgtatatcattcataaaatattcttcttccaaaaggataatgatgcagctcatgcacatgatatttaatctatgaccaacatatgttaatctcacatgaaaatcatattctctatatgtaaatatatgtgtatatgaatgatttaatctgataaagattttggtgaacatgcatcatttttgttatttactctgctgtttgaagtttgaaatgaaccagttttgaaattgtagagatgattgtcctgagtatcttaccacgatactgtattctgtagactctatattatagtagattagaaggttgtgacccatttattcatttaaatcattgccaaatctatttatatttttactttattcatcttactggacaaattagttacacaaatttggaagctccttttttttttctattttaaatttacccctcataaacttca[131 bp omitted]cctccgttgccgaggttcaagtgattctcctgcctcagcctcctgagtaactaggattacaggcgcccaccaccacgcccagctaatctttgtatttttagtagagacagggtttcaccttgttggccaggctggtcttgaactcctggcctcgagtgatccacccacttcggcctcccaaagtgctgggattaccagcatgaaccactgtgcctggccttatcttataaaatgattttatagattttagttgcattccctctcaatctttgtcatcctggattgtgcagctccattaggtatttcccaaagtgatggaatcagaattacatataatattctatagctaacataatggctatgaaaactatggtgatttctcttttgtttatttctcctttgcatccagagtctcttgcattcctgttttgtactgactacaggatgaatggtatatttttgaagctgtgacagattgatagtttcacataaactatacatttaaatagtatttaacactgttttgaaggaaatgaagtaacatacttattttttaaaattttagtatggaagagaaactgaacaactaaacaaactcagtagaggagatggaagacagaatctcttttcttttgattcagaagttcaggtattaatgatacatttctttaatagtcctagaattattgcttattcagataaacaacatctttgaaatgttgaaatcactgtttttcttgcaccagtggggaatatagattgttttatatttgtcttgtttgctttgaacaggtaacttaacaaataactcttcactcaaggggactgtcacatatgcagataatttggggctgaattatatatatatatatatatatatatatatatatatatatatatatatatatatatttctcagtttcttgtattcttttcacttccttttgctcctcaaaatagataaattaaagcaccgttaaagatggttacagtgttcttttagcccatgaaatacaattgtgatctagtggcagaaaatatctccagtataaagaacatatgagtcatatgagacatttatttttcacatttgatgtaggcctgtagaactaggataattgtcatgtctggcttaatcacactttaaatggagggtggtgcaggaaggtgcaggtttatacgcggatgtgtattttaacctctttcatgagagttagatgtgttttgtagtaagatatatgcagttaatatttaagtctatgacattttctaattaagtttttaatttgtttaagtgggaaaggtctacagtatttaagtattacaaatatttttcctaatggaaaataccttttgaaaaaatgaaattgaggaagacgaaattttttggctttcttttccctttttctacatgagatttcgaatgaaaattttttatttagtttgaaatcggaaaatgtgcattacagttttttcttccacgaaaatatgaaataatttggggaagtctgattttgttgttgtcgttttttcttctttctttctttctctctctctcttctttctttctttctttcctttttttttttttttttttttttgagatggagttttgctcttgttgcccaggctggagtgcaatggcacgatctcggctcactgcaacctctgcctcctcaagcagttctcctgcctcagcctcccgagtagctgggattacaggcatgcaccaccacgcccgactaattttgtatttttagtagaaatggggtttctccacattggtcaggctggtctcgaactcccaacctcagatgatccacccgccttggcctctcaaagtgctgggattgcaggcgtgagccactgtgcacggcctctttttctttttttaagtgtagtcaagtacagtagtgacaaggggagaaagagtagaacaaaaagttcaatatgtaattgactgaacaatcaattgagataactcactacctttgggccagccattgttgtttttttctttttgcttcatatggttttctaattaaaaatttagtttaaaatagaaaaagtatataggctataaataatgcaaacattttccttaatgaaagtatcacacaagaaaatggaattatttggagaaaataaattttaaaaaataatttcatttccctttctccccccacggagttaaatattgctttagtgcaagttatgtgattttttttttttttgtaaaaaagtaacagtataatgggcctcagggatgtttgttctaagatattcattcagaaatttacttgttccaagcatgtctgagtctttgatcctcccacccatgactgggctctagttggacgtgttaggctgtttcattgtatacaaaggagccaactgactgtggttgaaactaaatccagtatctttacaaatttgtggtgtagcgtttttgtggtaataaaactgaactggttttatgtctgagttgtttatcagtgagctatggtaagagagaaattcacagttgtgatgaagctttaaggagaagaaattgaatgtaatgttggttatggaaggcagtgtcgcctcggagaaacccatgttgtatctgtcgagtaccttttctaggtgaggtgccatcccataattttaccttttcttttggccatagttcattgtttagagacatgaccttagagaataaagaaacactggctgattaaaggggatggctcaaacgtagagctgaagaaggccatgtgtcccaacatttgtactcacaggccttagaagggaaaggatttgaaggctggagtggtttggtccagtttctctttccattctactgtctgagtaacacagaaaggagagcagataaatgggtggaaattaaaattgatctccatggcaatgacttgcctccacagatggatatgtgttcaagagggagctgtctagtcccacacattcgcattccttttgtagataaatagattgaaaggtgaagaagtcaagctttcaggcacaaatcttacacattgggcccttttaaggaggtttcagtcagtcatactgggtaggttagaacagctataattatccagtattcttcaggcataatacctgttttggcttgaattacttaggtaattgagaaaaaattttgtgtttcttgtcttgagttttccatactgacagtgttattctgctcagatccacccaatcattttctgcctacaatgtctatggccttaatgaaagtacagtaaattgtccccacaatccacacttttcttcccctttgtgaatagaatataagtctgttcagacattcagcatgaacagatgaacttagattgcctgagcaatctttttctttgagagacagagtcctcccctactgaaaggaattccttcacacccaatatcttcttcttaaacttgtttttatttcaaaataccaataatttttaaaaatcgatttctgtggcagcccaggtccattgcccagctctgttagctgagctcagtgttgctcagtttcctaagcggatgcctcttactctgttcataagttaaacgtaggtagtccatggggttccagccttttgtgcctctcaacctaaatgctgctgactcccacgtccagatctctaagtcaggcctctcccatttttccaactacctactaccgtcaccacaaacacaacacatcccatactgaactcaccatttctactcactgtaccccaaaatctgccattcatttgtatttcacgactaagttcataacatcgttatctattgaatctcccaaattagagaccactgtgttaatcttttttttttttttctgagacaggatctcactctgtcacccaggtcggagtgcagtggcaccatcatagctcactgcagtcttgaactcttgggctcaagccatcctcccacctcagcctcccgaataaccaggattacagacctgcaccaccatgcctggctagtttttattttttatagagacaagggtctcactgtcttgcctaggctggtctcgaactcctggcctcaagcgaaattccctcctcggtctacatattagttttgatgcttcccatacccattcctgtcaattttgcatcctgcacagctcaaaaacgaaaccaaatttcgactgtcctggaacatatattgtgtggggaagacaaagaataaacacatataaaaagtaatattagaaagataaatgagagaaagggagtatagactgtcagggagtgtgcagttttctatagggagttaggaaaggtctccctgcagaagtgtcgactgatcagagacttggaaatgagggagcaagccatacagctatctgagggaagagggttcctgacagagtagcaagtgcaaaagccccggcatgggagtgtccttgttgtgctggcaaaataaccaaggaggccagtgtggctgcaagagggaagagggcaattgtggtaggagatgaggtcagagcagtgagaagagacagggaatcatgccatgtagggctttgtaggccatagtacagacttgtgacttttccattgcccttagatccgagtttcatcatctccctctaggatttctccatcactgtttaaccttagtgtaaaaagtctataaaagcttgttagatgaaaacataaaaagggttcaaatgaagaatggacagagaactgttggatttttgccattttttgtatattgatgtaaatcaatatgaatcccatctttttttgaaaatgattcatactatctcttttatagaggttggacttttcaggaattgaacctgatataaagccatttgaagaaaaatgcaataaacgtttcctggtgaattgccatgatttaactttcaatatcttgggccaaattggagacaatgcaaaaggaccacccacaaatgtatgtatgactttgccttctaccccccttgcatcagtgcattaaagaaatgtctttctcaaaataatttgtacaccaaacctccgtgacatgcaatttacctatataacaaacctgcacatgtactcctgaacctaaaatgaaagttttatatatataaaaaagaaatcttattacaataaaaaaatgaagaaacatctttgtatgactgagaactattaataattgactgtgtgaaaattccagtgccacatattatgataaatttgacatggaagaattttatacatctctttcttttgccaaaatatgactatgttctcattgtgaggattcatgaaaatcttacctactcagaatagcagatagagtaggctcttgatgttcaagaggagcatgtctcccaaacttgcaaaatcttcaaatgcgtaaattctactagataatatgttttcttctatgaaattggttcgtagcaatgagtaaggatcaccatagccatgctgggatacagatgctgtgcagtctgctaggctcggtcactattctatagcattagattcattttggtctacagagaaaattctaagtgacagctctcatggatcatttgagttgcttagaaatccttgaaactgtaagtgtaaaatcttcagagagacttttttgtgttcatctttattttttcgttctagttttgtctattaaaaataaaacagtgatgagggattctcttacaaaatagcttaaaagtacaacagacttttctgtgtgtaaagggttaatctttatgccatctggcatgaaatttctctttgtgaccatctttcaaatgccatctgtagagaggaatcatgtcttccaaaattgctgatagggcaaagcttttgtcaagtactttggtgttgactgttattagcgcttatgaaatgtatagtcaagtaagttggaacataacagaagagaagatttatttctatactgtaatattggcattattttttaggtagtttcagtaaacgtgtagcgaataaaattttattcatagaacaatttgtgttatttaaatgtagcttttgatttccatttttttggtaaactttataacttgtgaaattatctacacctgacggaagttaaaatttgatgaagtctgttgttttggaatgccctttcttctgtgcagataagccataatataattttagctaagtgttgaactcagaaaggaattgtaatcacagaaactggaggaatacaaaacttattttgcacttgtgcccctccccgccatgcccccactaaagtctcagttttaaaatgtaactgttttcattcccaggttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacaggtaacgaatgacctttagtcttagcagcgtattcagaataagaaacagaaatattcttgtattatttcatggtttcaggccaatgttttcatggcattctctctcttgtaaggtctgtcgatagagatttttctggttactgaagtttgagggcaaaaatggaaaccaatgaacatgctagtaacatgttatcaaaggaacatttttaatgggaccatgatgtgagacacaagggaattattttgtgagatagaaagctgaaccaggccaggcgtggtggctcacgcctgtaatcccagcactatgggaggctgaggcgggcagatcacttgaggtcaagagttcgagaccagcctggccaacatggtgaaaccccatctctactaaaggtaccaaaaaaattagccaggcgtggtgatgtgcgcctgtaatcctagctactcgggacactgaggcaggagaatcgcttgaacccaggaggtggaggttgcagtgagccgagatcacgctacactgcactccagcctgggcaacagagcaagactccgtctcacaaagaaagctgatacagacacccataaacacacctgcacccacactcatacatatacttctaagcaaggcaataagtgcttgaaagttttggtttttaagaaaaattgaccctaaattaactctcccacccctgattttcatgtccattatgagtaggtcatttgaatggagcatatgggctctttatacaaggagttttacttgaaaagcaatgggcgggaactgcttgtgtcatagctgtaatgctacactcttctattctatctggagcaaagaatccctttcagaaagagcttaactgttccttggaattctgacctctgaccagactagaggccataagaagttagccgagtggattgatcatttgctcgctagacttttgcagctaaaaggaaatgagagcacggcatagaattaaaagtagaaagaggcatatgaacaaagctgttcatgttgtaaggagattgatttttttctaaataaaaatactattctttttttcctgattataataagtacattcttatgtagaaaattcaaataatataagaagtataaaaaagaaagtaaaagtctccacccaaaagacaatacctattaacattttggtaaacatcttttcagacatctctgttgtgtatatagaaatatatacacattatgtgtatgcttataaaaattatattcatgctgttttatacctactgtattcttttaatatcatatttatcatcctataccaatatctatagatcagtcatatttatatgaaaggctaacatgacatttcattgatttagctacttaagacatttctaattatttgctatcagaaataatgctgcattgaacctcttgtgcacacatcttagctcatttgttgaattatctccttagaataaattccaagcattaggatttttagggtcaaagattatgctgatttatatagatgatcaaacattggggaagactgctttacatggactgtcactgtctttttggggctgtggatttctggtggcttgtcctcaagttgtcccttatcccctgatagccccttagcttgttactgagactatagttgtcacctctgtgaacattccacaatgatggtggatgcttctgaaagagggatggagcaagtaaagtgttgtaaatatttgagaacttgctattgaattttatgtttaaaatttcctgcacaatatcaaataagtcattttaagccaatgtgtatttcccgtattacttcagtgtgtagcactcagctgtatgttcaatgcaggaagtttaaattatgatttcagatgtcatccagtttgtaatttggaacaggaagaaaatcaacatttaaaaaagatctcctgtgtgccaacattattccatcagtgtctcatgtaatcatactagtttgtgaaatgatataatcactactgtttgacagatggcgaaactgaagctcagggaggttaagtaaactgctcaccattacacagctagtagtggtgacggtaggatttgaatttaggtctgtttgaaataatttgatcaagaatattagacaaatgtaattaagtgccgaaatatataaccctagcacatgccctgccacatcctgggagctttgtaagtgctggtggctggggtagaggacctggcccattttctagcgggaggggccagcaaagtgggtaagagtcgccctggggtggggaggcatattcatgccccttggtgggaaacaaggactgggccatagaccttgtcctaaacggccagacctccagcccacgtgggatttctgggttctctctggccaccttttgcattctggggacagggagaggaccagaagctgttgggacaaaaggtaaaacaaccccaaagagtgtcccccatcattggaatccctggtcagttagaaaatggacatctctgtgcctcagcatccttatctgcaagtggaggtggtgacagtacctgtctccaagggctgtggggaggcacaaataaggtgcgtggttctaagaaaacactcagcactgtgatgggcacactgggttagcgcagtgcagcgtagcagccaggagtagtagcactgacagtgatctcaaacaagtgaaaacagcaagcttttatcaattatcaactatcttaaaattatagtcctcattgctggcatcagtaggaaatgcttagagtactgggaatgggaaacaataggtgctcagtaaatgttagctatagcaataatcagtattactgttctcaaactcctgggctcaagcaatcctcccgcctcagcctcccaaagtgctgggattacaggcacgagccaccacacccagcagtattactgttctaatcaggcctcatcatatgagatgttgggtgtatgggactcagggctgagagagaatatagcatgggctgtgtaatctggaagcctgaactgcaatcttcttcacccacttactcactgcacaaacctttctgagcctccacttcttaatctatagaatatgtatatagtagtgcctacatttcagggtttttatgaagactgaatgagataaagcatgaaaaccatctagcatggttatgtggcagttagcgtaacactgcactcaaggtgcactgctcagcataccttctgcagggacagcccgggcagtctgccaacccgttcagcctcacagctcaaacagcatgttcccggcagtacccgaagccaggttctgtgaccttgggatgctttggtgggccacctgggtaatagcaaggtacctgatgtgcattacttcatttaatccatacaagaaatgtatgaaatcactactatcctgctatttcacagatgagaaacctgagacttagagagaatgtgacttgcttaaacccataaatgttggagccagaacccaagaaatttgacaagcaattttgaaccactttgttcactttctcaagcaaatttgaaccactttgttccatgcttgctgcttgggaattcaaagctgaatcagccattacgcaggatccttataagctgtttgacttgggggaaatcattagcctcttaacactcaattttctattctgccctgtctacctccaagggttctatctggtacaaatgagataatgtgtctgaaatgcattggaaactggaaatcactatattaacaaagttggtaatatatcaaggaaaaaaacgaaattttggtagagactcagtgatagatttttccacttgaattcactagtgatgcccctttaaacaacaggcataaccaactaacatgctatgtagatgatattatatttggaaggagtcaaactggacaggaggtgttcctgttccacatgcattcaaagaaaaatgtaattttggttgcatctacattagtacatttaagtaaagtgtatggggacaaaatgagttttggattctctgtctcctacctttgcattggaagcaccagagctcttgaactgcaacaaaggaatgtcttttagaggatgatttagtttttctatattagagcagtaaagtttctttttccttcttagtggaaataaatattagttaaatattaattgctcttgagttacatgcagctgcatttaaaaatgtatatctagttccactcgagaaatgtactcacttcgcatacacaaccaaaccaaagaggcaaagcagcaacggtgacacctgcgctatggagactaacagatgtgaggttggtgacaaaatataaaatccattttgaaaggaacgttggaagctttgaaaactctatgaaaggaaattctatctatttctagggtcctggacatgatcctttgttgaatatgaacattgtttactaaaaatcgttaaccataaacaaccatatgcacaagattacataagaaagtctaacggaagtacttttttcccagggaattttctcagtgacgaatccacatcctgaaatttttctagttgccagaattgaaaaggtactacagggaaacattacacactgtgcagaaccctatatcaaaaattctgatccagtaaaggtaatttataaaggttgttgatcaacatttcaccttaacgtagaatttgccttttactgatattttaaatgccattgctttgagcatgctatatattctgaaaacattgtatactgtgtatgtttgctaaaacttgaacatggcatattttcctattgtcattgatgttctgttaatgtgataatctgatttctgcttgattatcaaaataagagccaaaagcttttaggcaacatctgctaattgacaccatatccttgacaatagccgttcttttccttacagccctacatgaagtgctagaatgaatctcagagctgggagattaaagatgatccagtcctatagttcccaaatgtcagttcatacccagatttactcctgtctgtgatgaaacgagaaaagaaagacagacagtgaacatttcatgaagctaaatgtatttaattcaaagggctgccctttattctgagatctttgcccttcctactttttaaaggttatgcgtatcttcctttcatgaaatgttggcatattaaatggcagggatttaaaaaattattgttgagtgtccttaagtggcaatattaaaagttggcaaccctatattgtcatccagatttctagaaaattgtgaaattgtgaaattcaaatgtttggaaatcatcgctctaatctcatcctctccttttataaatggaaaaactgagaccccaggagggaaaggttcatggttgagttcattagtagcactccagctactgtgtatttatgtacatcaatctgttgtacatggcattttgttgtatacccaaatagtgtttattaaatggaagttgctgatgtgatgggactaatttgtggaggaaaaatgtctcaacaatatagataaaagcctccagcattctgtatccctagggataagcatccagccagcatttcgagtctgtttagactctataggcagtttatctccttgtcatctccctgtgcctgtgcaaacagcagctcctgcccacacttagactaattgccttgactcctggtgacttgctccttgtcttgggagtagaaagggcagctgtatccagaaaaaacttctcccaagaatgatgagcatttgcctgctatgtgaagtaaagtacatgttaaaaccactgaacatttttccagtagaggtcttggttcaaagtgtgccctatatctatttcgtctgtcttctgctataagtgacagaagctctgttaatgagaaaatccaaagcctttatgaaatactttggacttgaaaaatggctggctgatgcatgttattctgcttgtggctatttctatatatttttttgagatttttgatgttttgtaatggtaggttggggaaattatttttctgggtgggtccatggcagtttgaacaaatacaagcctatcttcttgtttctgaccttagacggcccagaaggtgcacaggacagctaaacaagtgtgtagccgccttggacaatacagaatgcccttcgcttgggctgccaggtttgtacaaatataatcctgacccgctcactcgtgttcatatgtgaagttaagggctgttatacttaccagcattcagcactgtgtttctggcaggccagttgtatcttgggacacttgggatgtaataattattatttttgttgttgtttttgagacggagtttcgctcttgttgcccaggctggagtgcagtggcgcgatctcggctcaccacaacctccgcctcttgggttcaagcgattctcctgcctc[219 bp omitted]gaccctctcattttttttttcatatgtcttgctttagggaagttttctttggctttggttactgctctgactgacaccacttaattttactgcatttaaaagcagaatttatttggtagtcatggaattttttcagaaaagcagaaattatagtgagttatgtacagtataccccctatttcagagttggttgtgtttatgctttgaaaatctatcatagaatatttctggaaaacatactgaaaattcagaggcaactaatgaagtcattaaatgtgagtgtgtaattaatgtattttcttcctgatgacaaattctgccagcatgtgataactatatttcatatctgatggtaggttacattattttatccaaattttgtaaatccatgcagggatgacttaaaacaagtttcttgtttttctccctttttcaagtacaggttcactggcttgtttgtggtacagcctgtacagctcactggggcttctgtggaaaggacaccatgttctgaataattcaatcaattatgttcagtgggtgctagggagtagcataagggtaggagattctaagttaattaactcttttatttgtcactatttataatcatttcattttgggcaaggtctcaaaatgtattgtatgttggtggatgaaagatcactattgtccttgttttgcagactggtaaaaaaaaatgatagctaggggtaggtgaatggcaaagagtagcagaggttggtgtatgtaggcattatagaaggtgaagtatggcttataaatatcagcatatttttaatgctccagcctgaaaagtccattgctgc[184 bp omitted]ggtggcgtgcacctgtagtgccagctactctggaggctgaggcaggagaa[131 bp omitted]ttggccggccacagtggctcacgcctgtaatcccagcagtttgggaggctgaggcgggtggatcacaagatcaggagttcaagaccagcctggccaacatggtgaaaccccgtctctgctaaaaatataaaaattagccgggcgtgatggcaggcgcctgtaatcccagctactcgggaggctgagacaggagaattgcttgaacgtgggaggcggaggttgcagtgagccgagatcacagcactgtacttcagcctgggcaacagcaagactctgtctcggggaaaaaaaaagttatcaagtgctaactctgttcaaggcacttatctacgtgcttcatgtctattgtcttaaaaggtgggtactgttatccctgtctttgaagatgaggaaattgaggcccagaagtgaagcagaaagacaaaaatataaattattttccaagttcacacagcatgtggcagaacatggatcagaacccagggcacctgccttcaaagccatctctagaccactgtggcatacggtccctctttgggccataccagtagctgcttgatgccgttttaccagtagaaaagttaattttgaagtcttcaaagttagaagctttgatttccagttctaatgaggaattaaggtatttttttcctcctgaattgttttggttctcagcagtagtaaaaacttactcaaaaggctgggctggatgtttaaaagatatatgataaacctctgtttactagaaataaaggaggtatgcttagcgaaggatatgaacagacacttctcaaaagaagacatttatgtggccaacaaagatatgaataaaagctcatcatcactggtcattagagaaatgcaaatcaaaaccgcaacgagataccatctcatgctagttagaatggcggtcattaaaaagtcaggaaacaacagacgctagagaggatgtggagaaataggaacgcttttacactgttggtgggagtgtaaattagtttgaccattgtggaagacaatgtcacgatcctcaaggatctagaaccagaaacaacatttgacccagcagtcccattactgggtatatacccaaaggattataaatcattctactataaagacacatgcacatgtatgtttattgtggcactgttcataatagcaaagacttgggaccaacccaaatgtccaacaatgatgactggataaagaaaatgtggcacatatacaccatggaatactatgcagccataaaaaaggatgagttcatgtcctttgcagggacatggatgaagctaggaaccttcattctcaacaaactaacacaaaaacagaaaaccaaacaccgcatgttctcactcataggtgggagttgaacaatgagaatacatggacatggggaagggaacatcacacaccggagcctttcggtgggttggggggctaggggagggataacattaggagaaatacctaatgtagatgataggttgatgggtacagcaaaccaccatggcacatgtatacctgtgtaacaaacctgcacattctgcacatgtattccagaacttaaagtgtatatatacactttatatatacacacatatatatatatgaagtaggaacaatggagttaattaatgcctattaccacatcttcagaggtatgctggggggaaatatgtttcaggctatagctgcttccagtgtgttgggtgcgtgtatattgttttccattttagcagcagaatagttgcttaaaaatgggagaagaggaggggaagggaataattcaagttcatataggaaactatacatatatagtcatccctcagtatccatggggcattggttccaggatctcccacagataccaagatctgcaaatgctgaagtctctgatataaaattacgtagtatttgcatgtaacctattcacatcctcccatgtactttaagtcatctgtagattacttataatacctaatgcaatgtaaatgctatataaatagttgttatactgtattctttagtgaataatgacaagaaagtctatttgtgttcagtacagacacagttcttttttccaaatattttttatccatggttttttgaatccacggatgcggagcctgtggatacagagaaccgactctacattgtaatctccccatataaatttatccttatgctttttatgaactttatggaaatatacttcacctttgataaaatgtacatattttaaatgtctagcttcatgaattttcatgaatgtatacagtcacgtaaccaccaccccaaccagatatggaacatgtctattaccccagaaagtttcctcatgtcccttgtccattcagccatcttatccctgtcccaggcaaccactgatctgattttcattgcagatgacttttaatctcttttgcaccttcatataaatggaatcatgcagtatgtcctctgatgtttgctttcttgtactcagtgttcttgagattcatccatattgttgtgtgaatatgtagttcattttgagcagtatcccattgcgtgaatatacagcagtttgcttacccattcactttttctgggttattactagtttggagctatagcaaataaattggctgtgaacatttatttatataaatttttgttaaattgctgctgcgcaaattaagaacattcatgtaccatgtggaaatatgcctaggagtggaattgcaggattgtagagtgatgggtgattaacttaatgagaaaccgccaaactgtttccaaagtggtttcaccattttacatcccgaccattgctaattttatcttaatttatcaacatggaatttttttttttaaaaaaatgcttctgttgctgttttagacccattttcaaagatactcaaggctctcttgatctggatgggagattttctcctctgtataaacaagacagtagcaagctttcaagtgaagacattctcaagttgctctcagaatataagaagtaagtgtttggtgtttctgcaataagtaaatataatagatgaatcctcagttttttaaaatgatgaatgtgagtcatatatgggaaaaacagaatgattaaaattgtaagtttggatagagggtaaccagtgcattcagtaatcataattttaactctaaaatattattattttatacccaggccagaaaagaccaaactgcagattattcctgggcagctaaacatcacagtagaatgtgttcctgtggatttatcaagtaagaacatattgcaaataaaccttaagcataatgtttgaatgtcaggttgttatcctttcaatatttttcttgaggtttacgtggcatattagtttcccagggttgccatagcacaaagtactgttacaaattgggtggcttaagacaacaaacatttattctctcacagttccagaggctagaagtccaaaattaaggtgtttgcagggccatgctctctctgaatgctctagggaagagccattccttgcctcttcctgccttccagtagctcccagctaaccttggcatcagttggcttgtggctgcatcactccaacttctcctctgtcatcacatgaccttcttataaggacaccagtcattggatttaaggcccatctaatctagtatgacctcatcttaactaattgcatctacaaatatcccatttctaaataaagtcacattctgaggttccgggtggacatgaattttgagtgggggcgtggatgcttttcaacccagtatgcacgatgaatagttacagattaggaagtgaattgagttgattttatcagatgctgtttcatatatacgaagttgtgagtgtgtcccagtcaggttctattgccttttgcctttggtaacttttacttctgtcatcaactaagagatgaaaaaggagaaggatttcttttcttgtctaaggacaagaatccaagatcccaggagaaaaatagaagacacaaaacacaatttgcaagagataaaatgaagtagctagtaaatatgtgaaaaatattcaatcttagtaataatgccagtaaggcaaattaaacaatatgcttttgctcatccatcaaatctattaaaatgtttaaagtgaagctacctaatgctggctaggttttggccaggtggtatcacctatcatgagtaggagtacagtttggtaatagatatccatagatgttcataagtagggcattccaattctgagagtatatgcattcattcactgaataactatctattgagtaaacgtttattgactaccaacgaggtgctttaaacgtagggagtttaaagtctagaaggagtgacagatagtatgcaagcaaacgagttgtattactccgtttttcacacggctataaagatactacccaagactgggtaatttataaaggagagaggtttaattgactcacagttctgtatggctggggaggcctcaggaaacttaaaatcgtggcagaaggggaagcaggcacgtcttttgtggtggcaggcgagataaatagtgaatgaaagaggaacttccaaacacttataaaaccatcagatctcatgagaactcactcactatcacaagaacagcatgggggaaaccgccccatgatacattcacctcccaccaggtctctccctcaacacctggggattacaattcatggtgagatttgggtggagacacaaagcctaaccatatcacaagggcagctgtaaaaagggtagccagggaacacctgtcttaagctcaggaactgaagagggagaaagagagccagcatgtggtgattgggactgaacattttcagactgagggcatcacatacgttgtaaagaccatcacatatatatgtaaagaccttgaggtgagaccaagctgggtttgcatgaacagaagggaatccagtatagctctagtgtagtatgtgatgggaacagtggagataggagataaaataggaagcatcaggtcatgtaaggaattgtgttgactgtggtaatgccttaaaaaattgaattttattctaaatgcagtgagaagtcaataaagaatagtaaatggaggtgtggcatccactttatattttaaaacatctaagagtacaatggattattttttcctaaagaagcaatttgaaatctaggcagaaatggatccataaagatgttctttgcagtgttatttatattggaggaaaattggaaacaatcagaatccaacactgtcagtgtggttaagataatgatgctacactgataccatgaaactttattgcagccattaacagcaatgtttacaaagagttcatggaatgagacatcagataaatgtcgaaaaatcaggataaagttctatatatagtgtaggattttcatatcactatatacaatatgcatagaagactaaaagaagatatgccaaagtctcaacagtagttatctctgggtggcggaatgagcaactgtccttgtctaccttcactgtctacctccagatgctctgttataggcatgtatcactgtaataatcagaaaagcaaatccaacaaaaaatacagcatcctcaggtccaactctccctgggtcttccttcatcattactgctctgcagcaaggaccagcagtcttagagccccttaagtatatgaataacctttactacagtgacgatttcaataacatatgctgctaaacttctctgaggcttagtattttttcacggtcggggtattgagtttatcattggtaacacatcgtaagatcaaaaggcctccattatttcttaggtgaaaatttgcacctgtaccaagttagcttttaaaaagtgacttgccatgaactaattggaagcataaatttaccgttatttccctgataccaataaaaatttgcagtgaaagctaaattgctgccacaggagggaaaatgaaatggatttctttgcagagtttaaatttgtcaaaattatgatgtgttatatttggcaaatcactcgacattgagaacgaaatagcactccacgtctggtatgaagggttccactaaaatcagcatcagactactcagtcttgtctttttgggttcttaaagttgtcatgtgatttttttggtcaattactaagaattatgttttttaaatcgctctttgagaatgcaattcatgtatattttttatacatgcaggaatgtgttaatgattattaaactgaatgatctttgcctgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggtaaccatgtaaactatacatttttggagtataaaatgttatttataatctgctaattgtgtgactcattttgactgattaatcattttaggcaaggaacattgcagtctgtgtggaattccgggattcagatgaaagtgacgctagtgccctaaaggtttgtttatgatattgataggcatatgtttttagtagagatggagattttggtactcagtagtcttatgctctaggtttaatttgtatcaacatcaaaaagaaaatgttctaaagtgacaaatgtaatactttcttttctactcttacatattaactataaggcttagtttaaatattaatgcagtaggagcatatatagctttaaaaatgccaggttttggcttttgctcctttttgattttgcaattgcttcaatgcccaattgcaaggtcgttttcttatgacctgatagtttataatggtaccatcaagggactataaactcctttctccttgaaacctgaacaggctttgagctgacagaagcacagcatgactgctttgatctgagatacgacttctactccgtgactggccaaatggtgcctccagtcttggattgtggtctatgaaaagcagaatctcagtcttatctgatacagcaatccttaaatacctgtcacaccacagtgcctttatatttttactctttataactgtaacccatcaatcagggacctgaaagagaagtcagaacatctagccagcaagaagtgtttatttggctccccatttctcttgcatcagcctaaatcagacagatggatgctgggtcttacactcaaaccacctagggaaacaggctggaatgcccctgactaagtaattgaataatagcccctacctttgaaaagagattttttttttttatgtatacagagaaacttaaattaaggatttgctggctcaaattctgtatgttttctctggttctctgttcagtggagatgagaacaactgctctatttcctccatgcaatatccttttgtagacccaatgactcttaggttacttctcagcagttcttgcaaattgccttcataaccatatttaagaagagttggatattcacttatatggagtttcaatttcatttcttagctggcctggattgctcactctaaagtaacagaatgaggcaattagtacgttggcatgctgactccatattcatccttgagcctattaggcctatagaagtgaaaaaatcccactagaaatgaaattggatctttccttggaaccatagaaagccttacatttattttattggtataacagaaagccactgatattttaaaatgtggctcataaagtgccacatttaaaaatgtgagagaacagcaagcttgtctgtagcttaatacacattcaactttttaattcctttaggccaggaatgtgtctgctggagctttttaaacacgcttcaccttgcccactgcacaaagagcgttcaacaaatgttgccgactggttgagggggagcctctcatattaagaaatgcaagtagcataagagaagtaagctttacaggcctggtttgagacaagtatttcccttccaaatgagtaggcctgttcagctccttactgtcaactagtttgagatcgtgtttctttgatggctggaaattcagaagcatccatacagccaagttacatggtgtctcatttggtgtctggagtgactgtgtaaatgattgggaatttacaggctcacggtgactgccaggtgggcttggccatggccctatagtcacagatgcctctaactatatgtggttccatggcatcacatttacagacctgcatttagagcggtgactctgtttctttcttttgcagtgtatttatggaaaacctgcagggtctgtttttaccacaaatgcttatgctgttgtctcgcatcacaaccaaaatccagagttctatgatgaggtaaaaatatattatcctgacatttctaaaacacagtggttggaattctttttctctttgaatcattttcatcattttaccagcactttcaatccctgagtgttttgttccatgaaaacagaaaatattacaacaaaacagagtgttactggcctgcttggtgccttttgatggtagtagaagatttaccccccaatttaaggggctcttcgacttgaggtaacaatgcaggaaacaaacatgagagtagagctagggttctagccctcctagctttgacagtgctggctctgtaacatcaagtcacttccccctccagagtctccatttcctcagctttaaaatgagaaattcagaagagattttcagaatgcctttctagctctttccccttatggttttacacagtagggtgcagcctctctgtaactgaaatactaggaaagacagggatacagctgggccaccagaatcccactggctggcctgcatgcttgggtgcaaagcacataaaggggtatggttgggtctctgagcctctgtggttcctcctgactcagcctctcaaattgtgtctctgcctttgaaaccctgtctctgcccctctttccttcttcctacttctccacctctacatctctgtgtgcttcccagcatgtctcttagcatctctgtcacagccacttctggtctgtatgtatccagcatatccaaatctgtagtctccttttgattcctatatgtctctatggaacctggatgggcatcccagcccagacgttctgctgtccctgcttctcagtccacatgtctccattcttggcttggtctgaaaccatccccccggctgtggtgattttgccatgtccacctgctgttgtatggaagccttatatcccagccttaggccttgctcatttccttctcaatccaatgtccctagtttcatgggggatggggaggggaatagtatttttgccacccagggagggagtatgcccatatttatgtgcagcagagcattacatacccagatggtctggatgctgtgaataggcatgttctgtagtgaaatagacctaaaacggacattagttataacatcaaaaccatgctttgtatgaatgataattggaccagatgtccatcaccaagttgtttaatatgtgtatctctgtaaccaacatcagtcactacaaaaaacttgatcatgtagtaagtaacccacattatttttaggatacctaaaatgaacatgcttttctttttttttttatagctctgattttttaatattccccttttttcctccctaatcattcttttcttttttattattattattacactttaagttttaggatacatgtgcacaacatgcaggtttgttacatatgtatacatgtgccatgttggtgtgctgcacccattaactcgtcatttagcattaggtatatctcctaatgctgtccctcccccctccccccaccccacaacagtccccagagtgtgatgttccccttcctgtgtccatgtgttctcattgttcaattgccacctatgagtgagaacatgcggtgtttggttttttgtccttgcaatagtttgctgagaatgatggtttccagcttcatccatgtccctgcaaaggacatgagctcatcattttttatggatgcatagtattccatggtgtatatgtgccacattttcttaatccagtctatcattgttggacatttgggttggttccaagtctttgctattgtgaatagtgccgcaataaacatacatgtgcatgtgtctttatagcagcatgttttatagtcctttgggtatatacccagtaatgggatggctgggtcaaatggcatttctagctctagatccctgaggaatcacctcaccgacttccacaatggttgaactagtttacagtcccaccaacagtgtaaaagtgttcctatttctccacatcctctccagcacctgttgtttcctgactttttaatgattgccactctaactggtgtgagttggtatctcattgtggttttgatttgcatttctctgatggccagtgatgatgagcattttttcatgtgttttttggctgcataaatgtcttcttttgagaagtgtcaatgaacatgctttcaatcattcactgtatattgactgagagagacagagagaatatttgcacgtgtacctttgtgggtacatgcatgtgcatcaaatcatttaaatctgtaatttgtctcttacatacttccaggaggcattacaaacattcggttgggatctgattagaaaattacttgtgatactttattacaaccattaatttttaactaagtttgtatgtcatggctgataattttcatctttaagagcaaagttgtgtttttcttctagagaaatttctataaactataatttgtggatactataagaccatcgttactttttgcatatttatttgtaatggcttaattttttcatgcaaaagagagcaacaacttagaaaaaaagttgtttttcagattcagtgtacattttaaatgggttgcattcattgatgcagattgagttgcatagtatccctgggctgtgatgatgtagttttgacttagtgttttagaaaattctgctgcaaaattgaatccaggagaatccattgtactctccagcaaaagtaataaatcaactctcacaactcagaatattgctgtcaaattgaaactgaccagaaaagcatttggaatatatttaaatgatacctactatttggccacttggccagtcctttaggaagtatttttggagcagtatgatgaaactgaactaatgtctgacagtttcagcttgagaaaacgaagttccatgtgtaattttgctttcatttcagattaaaattgagcttcccattcacctacatcaaaaacatcatttgcttttcactttttatcatgtaagttgtgaaattaacacaaagggaacaaccaaaaagcaagacacagttgaaactccaggtacgtgttctctttaaatgtctctctctacagttatttgaaatggaactgtccagggtataacctcttttcaccaagctatagaccacttctccccttgaccaaaaaccactgtattagttcattttcatgctgctgataaagacgtaccagagactgggaagaaaaagaagtttaattgaaccttacacttccacatggctgaggaggcctcagaatcatagcaagaggtgaaaggcacttcttggcagcagcaagagaaaaatgaggaagaagcaaaagcagaaacccctgataaacccaccagatctcgtgagacttattcattatcacaagaatagcacaggaaagagcggcccccatgattcaattacctccccctgggtccctcctacaacacctgggaattctgggagatacaattcacattgagatttgggttgggacacagccaaaccatatcaagcacatttctgattttaaaagttcattggtaaaatgcatattatatgttcattttagtatttctaccaaatatcattgtccatatgcttgccaatgtgcttagactactataagcaacataaagtaatattgctattctcaaaaagaaacacatattgcgatacagtatttttgttatttcttttatgtagaattgcccagcaaccagaattttccagttctgctcactgaggaagagggaagtgagcccagagccagggacatctgtgagccagagggaggttgggggctgactagttctaatgagaagataactgatttaacaaacttgaataagcttcagcagtgaagctctcgtcatgggcccattcagcaaggctttacgtaaaccaatgggtagcacccttagcagaaatagaaggccttgtgaacacagcttgtatcacaagcactttacgaacatcagcatgtcctaagattcagatcccagctagtctgtattattcactcattcattcattcagcaaatatttctgcatacaggttgagcatcccaaatccccaagtccaaaatgctccaaaattggaaactttttgagcactgacaagatcttcaagggaaatgcttattggaacatttcatattttggatttttggatttgagatatcaactggtattatgcaaatattctgaaaaaatctgaaaaaatcagaaatttgaaacacttctgttcctaaaaatttcagataagggatactcaaactgtattatgtacaagatattgtagtaggcactttggagaatacagtggagaatcaaacacagatctcatcttcagtgaggatatgatctagtaagggaaatgagtcctgcgtaaacaattataatacaagatagaaagtggtgtttaagaaagtagtgctacgtgaactcagaagagcgagttattcagctggtggagagacgagtggctgagaatcagagaaggcttctaggagatggtgtttgagtgaggccttaaagggttgggtggggtttgataatgcaacaatggcaggaatgtaggggattatggggtgaaggaacagcttgtacagaggcagagtatcaagaggcatggacaggaaaccacaagtagttcactaagcctggagcacagggtgctaggagggggatcataggatgtcaggttgaacaggaggcatcagattttggaaagccttgaataccaggctatagattttattttattctatcaccacagtagaactattggagggttttaaacattagagcagtttttcaggaaaaccaaccaggcagcagtataatgggcaaggcaagtagaagcaggaagaggaagaaaggaacaccagttagagggttatttcaaaagtccaggaaaggaagaggccacactatggcagtagcagcgggggcagagagaaagggaagtgcagaagaagaacatattggacctggaaagtgattggctattagagagatgatttagttagcaatgaagtttcaaaactgggtgattggaaagaaggtattgccaatagcaaaactgtgggtagggatggcaggtttgggacatcagttgagttttaggtgctagtgagacattggagtgatacccagcaggcagcaggactgaatatgagggagttccctttgcaggtagtatggatatgttctttatccccatagaaattgccgttagttcagggtaggggctttgaggattgagaagaaaactggcagaacgatgagaacccatgaccatgtgtacatcctgaaagctaaattactgattcattatccaaatcctagacagaagtggacaagatgctcagcggagcatgaaacagttattccgtgtgccactcatcactttgaactgtgcattctttaagtggcttcccacctttgagccagatggtgtgcttgacattgtacctttatagcttccaagtgctctctatgagttttgaataggggaaacgcttggtcgtgctctgattcatttacagtacaaaaatgttgcctaagcaatcccacagagacagaaagtagactatcggttgccaggggctgggaggagagggaaatggggagtgacttctaagggctatgggatttattttgggggtgatgaaaagttctggaattaagtggtggtcatggagatacaactttgcaaatatactaaagaccactatatgtacactttaaatagatgaattgtgtggtatatctgaatgaggtctcaataaaaatttctatttaaaaatgttgcttaagaacaagaaatagattttcctttcattttcctattttctgggctggaaatcttttctcatttgtcaaatttttagtttaactactttgacagagtcatttctaatggttcttctgctcatgttactttcctctgctttttataaaagaaaaggtctgggtaaagcatttctgtagttgaactagtaaagatgcccgtcaggcacatttcggagtctgagaaagccatttagtctacttagagaagcaatgttttagtctccttttaagaattaaagcatttgccaaattaaacacataaatgaaaacattctaaccagatttgtgttgacttctgtgttcacagtatcacacacacactcacacacagagtcacaaataattttaaagaatcagaaagcagtagctttaaaaaatgttctccagccaataccctctctcatatgccaaaactcagtccagagcaagcttttttacagctgagttataaacacttgaatcccagagtaatttctataatggaaatactgacaccactcaacttgagtaacacagatggctctggcttttttagctagaacatgatgagttttctaattgaaagccaaaaggctcttttggggagaactgttaagaaatgtagagattggggaaaatctcttgatggattcaagtcataaacactatttcctgcctgcattctcctacctacacctacacctcttccttctgtaatcaggacaagtctgcctaactaaatgatttatgcctactgccttgtataaatatggagtgtagccgtgactttgtgaccttaattttccatagttccttaccctagggttgccataagaaattttggaacatgtgattgttatctgaaatagtctcagccgtgagactctgcactcttagtgtaagaatggatgagaactatctgagccttttgaaaataaatccaccaaaaatatttcccaaagcataaagataatggtatcgatgcgcttttaaaggtttaaaatgttttcatataatctcactctaggtttctcaataattcttgtagatggaaaggccatgttgctgttcccatttttatggtcaaagaaatagagtacataacttgttagtggccaggctgggattcagagtcgatccaaacccattgttccttccccagtactcagttgcccagcacctgaactcccacatacagatccctggagacatcaccaccctgccctgccccctagcagtcagccatttgtgtagctgattgcatttgatatttcatttctcacagtttgttattatcttggcagttgggtttgcctgggtacctttgctgaaagatggtagaatcatcacatttgagcagcagctgccagtttccgccaatcttcccccaggctacttgaatctgaatgatgcagaatcaagaagggtaggaaaatactgcatttgttgaagtaatcatgattaaatgtgcaaaaaatagaattctgttggtctcgattgtttagtacaatgttactcaaagtggggtctgagggctggtgcgggtccacaacaaagataaacatggaatgtgcatgtttagaatttatagcagtttgacaaagtaattttatgtctgttgattttaataatttttttagtggggctcagattttgtgcataattttaaaaaattatttaagtaattcattttatcataatttataaaaatagtctgcaaaggattggaaatgtaaaatgatttatgatacatttattctaaaggcagggtattttctccagtaatctcttggtatgaaattaatacattcatttctgaaaaaaatgtttaaatgcataaaggtattatatgttattcatctatccattattatgttatagaatctcaattttctgttcacagcaatgtaacgtggatattaaatgggtagatggtgcaaagcctttgttgaagattaaaagccacttagaatctaccatttacactcaagtaagttgcatcatttgaattttgtcaatttttatacttgagtttgtttgattaaaatagaccacatttgattcctacagccttagagaatatgtgacctgcaagattttctcattagtaataacatctgtccaggtgcagtggctcatgcctgtaatctcagtactttgggaggctaaggcaggaggattgcttgagctcaggagttcaaagctgcagtgaactatgattgcgccactgcactcttgcctggaagacagagtaagaccctgtctcttaaaaaaaaaaaaaaacagtcattctatctcaaatattataattcctctcaaattacatgatcttttaattctcattaactgatttgagcctcacagaactctgaaaggaatgtggaagccatcatctccattttataggtgaggaaactgaggctcaggcaggttaggtgacttacccaaggtcacagagtagtaatcaggggaatcaggtcaaaacacacatttcattattctggttcctgatgtagtccatgctgtctacagaatcagtgtatatgggttccacataggacagttggactcccttgccagtgaagtgccatggtaaatttgggtactgaatgcctgagactattgttctgctaacttcctgctgctatcttttctttatcagttcacatctttattatttatttatctgtatctttttcagttcatacctttattcctgcttatttcattaaaatggagaagcagcccaacttcatagaacacactagtcaaagtcggaatcaaatgaatctttagctagttgggcataaatggtggcctaccccatgtgcttgtgtacatggcagatttacctggttttgctgctttgtatagtggtcaagagctgctgagcctgggcattagaataccggataaataggtctgcaagatacaggaggagggagaggtagagagcttgcatttgaggataatgaatcaaatttcatatggctgtttccatctgtgttccaggatctgcatgtgcacaaattcttccatcattgccagctgattcagtcaggctcgaaagaagttccaggggagctcattaaatatttaaaggtaaatgaacagcagctttctgcaaaacgtttgtttttcatgtctttctgttgccacattttggtgtgaaaaaaaaaagcaaacagacagtttaaaatatttttggctgtatttcctcaagagaatactttctatgatgtatttttccatcatgtggctgtttagaagcagacagcagagtggcaacattaggaagaaaatgtaatagccacaatgcagcatcatatttttgaaactctcatgaaaatgtttatttcaggtccataaattgatttttcaggggctttctcttcctgctgactgcccaataaaggtggaggatgctgtgggggaaagggccaggaggaatggaatcactttgacttggaatgaaatgtgaaattgttcttgtgtccatgggtgatagactaacaaaggggctagctaatgaaagacacatattttatgcatgttggcatattgtatcttaccacatgtatagaggacctaacacttggttttttccctgtgtgctaggactacagtgcatatcataatttgcctgacagtggctctcttcttttaattgttcctttagtaagatagctatagcaagtctgaggaaatattattttaaatgaaacatctttaggatttacctttggacatatgctattacttaatgatatactcaggaaacaaaaatgttcatttctttcagagaggtagtatgagatgagatcaaatatatgggttctggaatcataaactgagcttgtatcccacatgtcacttactagctctgtaactgaccatgaccaagttacttctctgagcctttgtttcttcatctgtcatgtgaggataacaatagtgcccatcttgtagggtggttgtgagacttaaatgagatgatggagctgggcatggtgcttcacgcctataatcccagcactttgggaggccgaggcaggagattgcttgagctcaggagttcaagaccggcctgaccatcatggcgaaaccccgtctctactaagaatacaaaaatcagccagacgtggtggcatacgcctgtaatcccagctactcaggaggctgaggcaggagaatcgcttgaacctgggaggcggaggttgcagtgagctgagattgtgccagcctgggtgacagcgagattctggtttgttttctttttttttaaaaaaaaaaaaaaagaaaaaagaaaaagattagggcatctgccggatagtaatcgttcatgccacacttatttctttagtgcttcctatgggccaggcatcattctaagcattggaaatttaagtggagaaaacaaataatatccctattgtcaaagagcttacttgttgagacagacaataaacacataagttaataaatatatacgtcatctcatatggtaataactgttataaagaaaaccagcacaatgaaggggagcagggatttacaaggggtccctgttttaaagtggccagagaaaatctctctagtaaaggcacatttgagcagagacctaaaggaaatgagagtgccagccatgtggatttctcggggagagctgggaacagcaagtacaaaggccccgaggagcttggcttggtgtgtttggggaacagcaagaatcccagtgtggctgggacacagagtgataggacattaccttggggaggttgctgggagcttgtcgagtaaggcttcataagccatggcgaggagtttgaatttactccgagtgagataggaatatggagctttggacagaagtgtgacatgatgtgactttggtttttaaagtgtcattctgcttaccatatagaaaacacactgttggaagagtagaagggagacagtcaataagtggtggctatatggctatatgttcttaactatcattaagacgtataataggccaggtgcaatggctcatgcctgtaatcccagcaccttgggaggcccaggcaggcagattgcttgagcccaggagttcgagaccagcctgatcaacatggtgaaacccatctctataaaaaaatacaaaaattagccgggcatagtggcacacacctgtaatctcagctacttaggaggctgaggtgggaggatcgtttgagcctgggaggttgagtctccagtaaactgtgatcatgccactgtactccagcctgggccacagcgagaccctgtctcaaaaaaaaaaaaaaaagaaaaaagtatgataatcatctaacttttaaatcctttcctcaggtaaatatctaggacttcaatatgtatgaatgctttgttaaggtttgttcttcacatgggaaagttttataaaagtttcaatcaagtggaatggaaaagaacatcattttcatatatacgggtattcttaaaatagaaaagttctcgtatttgtttttctgaagatgtggaatttctggtatttatgtgacctacgctctccctctagtggtagtcaatgaaataccatgtgatttcagaaatagccaagctcctctatataaccttagtgctgaaaaggattcttaagactttttttctttctttctttttttgagacagggtctcactctgtcgcccaggctggagtgcagtggcgtaatctcagctcactgcaacctccgcctcctgggttaaagtaattctcctgcctcagcctcccgagtagctgggactacaggcgcccgccaccatgcccagctaattttttttttttttttgtattttttagtagagatggggttttgccatgttggccaggctggtcttgaactcctcacctcaggtgatccgcccacctgggcctcctaaagtgctggcattacaggtgtgagccaccatgcccggccaagacttttttttttttttttttttttaacagatgaggaagctggggcccaagtagaggtgacttgcctgtagacattcaactggttagtagcagaactggggtgagactatgacaagtcccatgttctttctaccacaccttgctatctcttgttcctataaatgacattgtttcaagaattcatttaccatccacttgttgagctcttgttatatatttagtattttcctagctctttgaggcttacagagaagaataatttagggttattgtccataggggaacttacagtctaactgaagagacaggacatacataagttaaatgacagtctgtcaataatacaattaatagttcaaagcaatatatgattaaatgtccagtatgtgatacagggcacaagtgctgagggttcggtgaactgaggaactactgtagactagagggctcctgtctttttttttttggagacagagtctcactctgttgcccaggctggagtgcaatggtatgaactcagctcactgcaacctctgcctcccgggttcaagctattctcctgcctcagcctcccaagtagctgggattacaggcatgcaccaatatgcctggctaatttttgtatttttagtagagacagggtttcaccatgttggccaggctggtctcgaactcctgagttcaagtaatccgcctacctcagcctcccaaagtgctgggattacaggtgtgagctgccgcgcccggcctactttcttattttattcatttattcagtaagtcaccaaatatttattgaccatgtagtatgggccagacattgttctggatgctatgaatcaaatggggaacagtttagacagcataccttttctagttgtggtagagagattataagtgagtgccatgaagaaaagagcaggttaatgagatccaacatgaccaggagtgtattctacatagagttgtcagggaaggcctattgggggaaatagcatttcaagctgaaaggatgagaggaagacaaccttagggggtaaagtcgtgtaaaaggataacagaatatcacagtaggtgtaaacaccttacatcagcatgtttgaaggacagaaaaataaaagaccgtgtagctatagtacagtgtgcattgtgaggggaggatggcaagtgacaggtttggcgggacaggccgggtatgtcgtaggcatggaagcttatgatagctctttgttcgtggtagtttgttttgttttgttttgttttttaacaacagaaagatggcaatgtctaatttgcatttcagaaagaacactctggctgtcatgttgagaataaattacagaggactgctactggtagcagggaatgcccatctctcttttctacctggcactattctatttatcatttaccctttctcatctctgaggccttaccagacattccctacccacttgcacactcagttgcttctttgtgcattttgtatattccatgatcatgctatttactgttgatattgcaattatttagttccatgtgtttatcccctgtacactgtgaactacttgatggtagaaaccatggcctttatttgtttgggtttacttttgtttttggtgtgcttggctattggaagttcatttgtttgccctttgtcgaatgagaaaatgaatggtttcactgaagtggggatttgtacttgccttgaaagagtagccaggatttggctaaaaacgatgaacagacacaaaggcaggaaagtatatgatatattcaagaacagtgaagaaaccagagataccagtttggccttgtagagaacagtgatgattgtttaggctgaaaatgtcagttaggtctgaaataacttggtcttgatactctacgccaggatttctcaatcttcgcactattgacattttgaggtagagttattctttgtccgtgagggtctgtgtgtgcgtcgtaggatatttagcagcattgctggcctctgaccactagatgtcagtatcactccctggttgtgaccaccaaaactgtttccagacattgccaaatctgtcgggaacaaaatggcccctggttgagaaccactgccataggctatggggagacatcgaaaaaatcttggcaggaggtggtctaatgtaacgagtatttgaggaagattaatttagaaatgagagttggatgtatggagagtaaagagaaattgtacagagacctgctaaaaagaaaatgatttatactattttggttattgattagagggtcttgaagacagatagtggcaaaagtcagggaatctgggaaagagaatttatgagttttttaagtacagagacttgatttatccacctctctatttcccctagcactacacattgaattgatatagaaagatgctcagcgaggtttgtttccttttttttttttttttttttttttttttggttagctggttgagtgagtgaatgatgtggagagaagggaagaaagaagaaagaaattgaacaactttcactgtttgtattatttctctgtatatatgatcacgtttcttctttttgatgtttgtaacgcacttatcattggagacacagtgttagcactttgaaggaaatgtattgtgagattcttagactgcaaaagtgcttccgttttgtagtggtgatggtgtagagccaattacatatagaaccactctttattgcattccacttaacttgtcaccagattaactgatgcccacattcccctgcagaacatacagaatgcctgggggttagtagatgcatctccagtatcatctccaaacatctgttcctccccactgccccaggcaattgagtgttggtttaccaggagtcagttgtcaattttctaaaaactgtttatccaaattatacttattagctttagtaaagtgtttaatgttaaataacaaaatctgagtgccaaatagaggtgtggattaagtaattaacaaaaaagccccctatccaatggaaagctcacttttaattgagcttatatgctagtcaatgtatttctcactacttaatttttttgctgtttcacatttgcaaattttatcatatttctgtttgttttcataactaataatgacttaattttagtgtttgcatgccatggagatccaagtcatgatacagtttctacctgtaattcttatgcaactcttccgagttctcacaaatatgacccatgaagatgacgttcctatcaactgcaccatgtgagttttggtgttataatacaaagatgctatttatttgagatctttcttattttttaatggaggtattcattactataaacttccctcttagaactgctgttgcattccataggttttggtatgttgtgttttcattgtcatttgtctcaagatattttaaattttcccttttcttttttgactcaggaacatgtttaatttccacctattttgaattttccacggtttctcctgtgattgatttctagtttcattccattgtggttggaaacaacacttgatatgatttcagtcttcttataattcttagggcttgttgtgtggcctaacatatatggtctattctggagactattctatgtgctcatgaaaagaatggatattctgttgctgttggatggaatgttctgtatatgtctgttaggtctatttggtctaagtgtagttcaagtccaatgtttccttattacttttctgtctggttgatctgtccattgttgaaagtggggtattgaagtcctctatttttctattgcaatatatttctcctttcatgttcgttaatatttgctttatgtatttaagaagataaatatataagttccaattgaactttttccaattatgtaaatgttctgcacttgtgttgttcaatatagcagccaccagcca[133 bp omitted]gttcaagcgattcttctgcctcagcttcccgagtagctgggattacaggcgcccaccaccatgcccggttaattttgtatttttagtagagatggggtttcaccatgttggtcgggctggtctcaaactcctgatctcaggcgatccatccgcctcggcctcccagtgctgggattacaggcgtgagccaccgcttcctgcaggaactgaatttttaattgtgtgtaattttaattttaatcaatttaaatagacacaggtgactagggatgcatatttaacagaatgtggccccaagccatcaatttttacttgaaagaataaggaagtattatttttatgtgaaaacaaacaaggatatattgtagagtagaatgcaaaatgcacctgaattttgaaatcaaaacagggtacttaaattgtgggctgagtgctggaagtttctggctttggctttgctgcctctgctgttgccacaacctcttccagcaggcctcacaccacagccacacaccatttgcgggcatcgctgctgttggggatagtgttgttgaaaatggaagaaactttaggccagtggtttccaaaacatggttcccataccagtagcatcaatatcgcctgggaacttagtaaaattgttaatcattgagcttcactccagacctacaaaatcagaaattccgggagaggggctgagcaatctattaaaagggcccaccaggtgcttctgatatatgctaaactttgaggacactgctagtctcttacccccaattatagttcatatcattacacctgccccggctctcccttccttttccccgttgacatgcttttcattgcgtctttattcctttcctttccttctcctttcctttccctttcctttccttttccttttcctttcctttccttttccctttcccttttcttttcctttccttcttttttttttttttttttttttaggtggagtctagctctgttgcccaggctggagtgcagtggtgcaatcttggctcactgcaacctctgcctcctggggttcaagcaattctcctgcctcagcctcccgagtagctgggattacaggcgcccaccaccacacccagctaatttttgtatttttagtagagacagggtttcactgtgttggaaaggctggtctcgaactcctgacctcatgatccacctgccttgg[141 bp omitted]ctcctgggttcacgccattctcctgcctcagcctcccgagtagctgggactacaggcccccgccaccgcgcctggctaattttttgtattttttggtagagacggggtttcactgtggtctcaatcttgtgccctcgtgatccacccgccttggcctcccaaagtgctgggattcagccttcattttatctttctattctcttccttttattctcactagaggagatctcaatatttacctaatttgaagtcttttactggatagtagctaccaccatgcttcagacacatacagagatttagaaacagatgtgacatctgggttgtcaaattaaatatccttcttttgaactaggaaatatatttcataaggcccaagcatgttagatgctgaaatctttgttatgcctaaactatcaccattatatctaatgcaatcatctcacttttaattattcaggcagtgttagatgttttgggggctagacatgacgatcttaagaatcaaaatatgttaattcattatagcatgacatgctgactcttgtgaatgtcgtttcagggttctcttacatattgtatcaaagtgccatgaagaaggcttggatagttatctaagatcattcataaaggtttgtggagtaaagtttctttctgagcaatttgttttatgtgacaattttgtcttacagttcatttttttttgtttgtttatttgtagtatagcttccgacctgaaaaaccgagtgctcctcaggcccagctgatacatgaaaccctggctactacgatgatagcaatattgaaacagtctgcagattttttatcaataaacaaattgctaaaggtatgaacacaggacacaacaaggaacaaaagcagccatagacacactttttttgataccctcccgtttcacttctagtctttcatcagtttcacatgtgacccgtcctttctccaccattttgcccatgcatccttttcctgaagttctccacagaaccttcttcaccccaactacccaccccctgccctcatttaaatgtgtaaaagaaagaattttggatcagatagacctgagttagaatcctgtatccatcacaaaatagttttgtgacctggggccaggtatttaacatttctgagcctccaagtcctcatttctaaaatacaagtaaagcatttaacacatcgttcctggcacattgtaggcactcaagaaatgatagctcttattattgtcattatttttattacttcttttattaatggtagaatttcgagtatcttggagtatatctgattggggcttctctctactcttcaaattacatgaggtaggcaaacatctaggctacttaggctgcacgaatgtcacatcaagagcagggttggggtccaagctaagtgcaggtggtaataagattcattgtctatagagcatttaaaagcggtaacaagataaactagaagttagtttgctcttattaccacttgagggcaattagaaacaattttggggataaaatactccccagtgggacaaaggttcccatccttcctttatatattaccagtcaaccctgaagtacaatagtacctttttgctaaaaccatttgcagatattctgtgactttgatagtgacttgggatcacttgaaaatgttagtaaaattcaaagacaagacccatattgatctgtcaaactttgctaagcttcagagatttggtaaccgttaaagattctctttctttttttttcagtactcatggtttttctttgaaataattgcaaagtcaatggccacatacttgttggaagagaataagattaaggtaagtaaattaaggtaaagaataactttcaattggcaaatgataattgtatatataagaataatatttgatggagacaaaaaaagctaatcttactctcagatagccatgccatgcaaatcccattttatatttaaaggctgctagtgcttggctttttcaatgttgcttacaaaacaatggatctattgcataaatctgaggtctcgcagttgatatgttctcaccgtctaatctgcagagacttttccacatagattctttcctataatcatttgccatgtacatctcattacctttgaagctttgcctttgtcttatggcttaaaaatgtctctcgagaagacccatttggttaaatcagacatagcgcttgcccatgcacgtggagtgttacaaacactttatgcactagatatgatcccggaatgtgatgtatacattttgttgtaatttttaattgtttgaaaggtataaaaatattttcttattcataggaatcataaagctaagacttgtgaagtacaaaatatttaccttatacttaattattttttatcagaattttcacagaatatgtttactgaaattgaagtgcatgcatactttgtgtgccaggaaaaaagtagaatgaaaactgcgttgtgtctgtaactcagaagcatgatattccaaagttggggcagaacaacccattcttgctgataacctcagtcaggtagattattagagatccagatagttcctgtaattatatagagtgaagtacatcttgaactagtgatgtcatttttaagttgggagaacaattatacatcagttttaagatatatttatttgtagaatgtgtttgaaagtaaaaatggcaattgatttagaccttttggaagtctgacttttttctgtgcctatttcatttcagcttccccgaggccagagatttcccgagacatatcatcatgtcttacattcactgcttcttgcaataattccccatgtgactattcggtatgcggagattcccgatgagtccagaaatgtgaactatagtttggctagcttcctgaaggtgagttcaaggcagctagaatgtggtaaggaactcctcttcattgataggaagcccaagaaaaaaattaagcactttctagaggctcagctaggtcttcataagactgttggaaaacttaggttgcttacaaacgttggctattgtgaacagtgctgcaacaaacatgggagtgtagatatctctttgatgcactgattttcttccttttgggtatacatctaagagtagaatgttggatcgtatggtagctctattttcagttatttgagaaacctccatagaagacattggcattggcttgtgttc[131 bp omitted]tgaaaccccgtctctaccaaaaatacaaaaatcagctgggtgtggtggcaggcacctgtaatcccagctacttgggaggctgaggcaggagaatcccttgaacctgggaggtggaggtttcagtgagccgaaatcacaccactgcactccagcctgggcaatagagtaagactccatctcaaaacaaaacaagaaaagatgtgagaagctaccttagtagtcaaatttaactatatatacaagataaaggtgataacaataataccagaaatacaaacaaatctgttcttgatagtgattgtactaatttacattctcaccaatagggaaggaaggttcccttttctccacatcctcaccaacacttgttattgcctcttttggataaaagctgtatattttagcttacctgatcacaacaaatttgtccccatcccccaatgaaatgacaaataattaaatcagaggacacatacaggtggcctagtcagaagacaagtgttgcttgttgtacacagtgtttttaagcatagtttgaatgcttatttaaatgggagcacatactttctaggttgccaccatccctaccactccttattacagccctgagcctcctcattcatttaaatcgtttctctgaccccgttggcttttgactttgcaacttttggactaaagcaacctgtttggtgatgtaaccacagtgtacatgttgctaatacgtgtaaatgtaaattgttagtgttgatcagtgaggttattttatttgggatataccagaagaaaactatatttatgaaagatggcaaactaccatcattaggttttgttattgtcagtatgtaagtggcagtgagagaatgtaactgttttttctttcttttttcttgctttctttcatttttttttaatttgagacagagtctcgctctgtcacccaggctggagtgcactggtgcgatctcagctcactgcaacctccgcctcttgggttcaactgattctcatgtctcagcctcccaagtagctgggattacaggcatgcatcaccatgcccagtatttttagtagagacaggggtttgccatgttggcctggctggtcttgaactcctgacttcaagtgatctgcccctcttggcctgaatgtaactgtgataaagtgggtaacaacaatatttgatgtgtggcagagacaagcgtgggttgcaaatgcacctagtttttacttgcctctttccattctccctctcttcatttctcaaagctcttcattactctcaaaactcttcatattaagaaccttgtgggcagcaattcatccaaggagttttagtttctaacatatcctcattgttaattaaaaattcacaactaggtttcacacatcttgagtatgattttctgacataagacttctctttgccagaattaaaataaagttttaaccctattacactagccttttttgtgtattaaaaaagccaacatccacatatctttttaaaataaactacgaattagattatctgaaatgtagaatattagcttcttccatggagtttaaagttgaagtttactatgtaaagggaatagaacatttttggtttagtagcagtatttacttaattcaagtcagcaaacattggcttgacttctgtgtggcaattcaaagatgtgagaggccgtgttagtagtcaaatttgaatatatatacaagataaaggtgataacagtaataccagaaatacagacaaaatactatagaaaaactagaaagggagagagagattatgaccaggcagcatgaaacaagtaacatagtgcagagttccccaagacaagagttgagcatgttgcagttagagggtccctgaacaaagatgaaatatgcatgttcaaaaattgttcagggacgagtgaaaagtcgtgtgatgagtttaggatgtatggagaaagagctggaaaggccatctggtgccaataatgaaaggccttgaatgtcaggttaaggaatttggactttgattcatatgcaatggagtaacaccaaatacttgggaggatacttttcttgctggtatgatagatgaagtgaggaagagactcgagtcagggcaaccgattagaaaaccaatcatccgcgtggcacaatccacttatcttttaggctcagctcttccctggcctttccatgcagtgttgatcaccccttctgttgttcacctgtcttttacatagctctgtggcactgttattgtgcactatcttttcattatttgtttgtcttcactattagacatgattatggaccatgccttattccactttgtatttctctagaatgtagtacattgtctcaaacatagtagatcctctaaatgtttgttggatgctggaataaataaatatgagcctcactcagtaatccagatgagaggtgatgagggtcttaccctgggcagtggcagcagaagtataaaggagagtatgagatgcaagatgcaggtagctggttaatcaaatattgaattcttcggatttcacagaaatattctaggcactatgaaggatataaaggaaaagatcattcttattgtccaatctaggtgagacgacaggaaaacagtcagtaaaatacaagctaatactgaaataaagtgtttaaaaggatccatggaccaatgtagttaaggaagatgggatttcatgagaaccttaaagaatgaataagaccagatagaagtagcgaaagaattgctaggtgtggcataagccaaagacttagaggtgggaatacacagtgcatctcgaggggataataagtgaatgatggctgagcatgctggtgcccgccttagtctcagctacttgggagacaggcaggaggattgtttaaggctgtagtgcgctatgactgtgctaccacactccagcctgagtgacagagcaagactctgcctgtctctctctctctctctttttttctgttttgagacagagtcaaagaaagtcaatgagatctattggcaaatgaagctggacaagtaagttgggaaaagactatgagtgttcttgaatggcaagctaaggaatttgaaattgtattagagacaatagggaactattggaagctttggggcaggaaaatgacaccattgggctaggacttagaggttaatctggaagcagatggatagagacatgagagacatgaagactgaggaggttaactgcagtttttcagttgcaaggtagtgagagccttaactaggacaatgacagtgggcaaatataaataacttggggctgtcacagagaagggaggttttatgctttgacttcactgaacacaaaaactcttttggtctgaattattaatatttacataggcaagcctcactttcatcagctaacagactaccttacacttccctttggaagtgggagttgaccaaaatgaggtcaactcgcttgggctttgagagttgaccaaaatgaggaagtgtagctgaatagattacagatatgtatgtgtgtctgtgtatgtatgtgtgtgtatgtatagataaatgtatatttgtgtgtgtggctatatatacatcttgttctgaaaactgtataattgaggcccttcagtcccaattccagtgatgccacttgccctttatctttttctttaaggtcacctgaagctcagaaagttatctataaaaataaaaatgtctttctttttgtgtggaaccaattttgaatttttaaaactttacatttttaaaatttagacttttagaattatgtaattaacccttagttttgttttggtttctatagcgctgtttgacactaatggatagaggatttattttcaatttaataaatgactatatatctggattcagccccaaagatcctaaggtaagttataaggacatgattgtagtggatgtcagacatctgagcataagaccaaagtgacatttattctcttctaggggattaggaactgttgtttttatttaggtagttggactatagacatacgtaaaagcaaggaatactggactgtgttttggggtccccaggaccccccatgtgttcaatagctcattttaaggattcacagactcaacatatagttgtattgatggctgagattcatgagcgtgacataatgaggatactcagctgaatcgggaaaggaaaagacatcaaatggggtgggtagcaatccacatgcagcctttttgagctctttccctcctgtgaagggtctcacagagcacagcctccttctagcagtgaaaatgcacttgtaagtgtgcaatatttctgttcaaggaagcctgtttaaaactcagagttgagagtttttattgggggctgattatgtgttggaggctggtcaaaattccagactctcagaaaggaaagcaaagcaggtgttcactataaatcacaatgtttgtacaaatagtctaagcaggctgacacagaaggtgcaacttaacatgtagggaacatttcaaaatttcattttttagatgccagccaacaagcaggccttttaaaggatagcagtcttggacctgctatgttaactctttcctgcacaggtcgcatctcaaggtatgcttagaatactaagcacttccgttgtgaaaaataatgcgctgtattaaattcttaaaatagcaaatgcctactaaatatgagctaatgtatcatttctttccatttaggttctggctgaatacaagtttgaatttctgcaaacaatttgcaatcacgaacattacattcctctgaacttgccaatggcatttgcaaaacctaaactgcagcgggttcaaggcatgtatttgcattttccatcatttgagtttgtttttttccatgttttgctagcgctagtgtagtataatgttttctagttgaaccagtcaacttgaaggtaatttcagaattgttactatctgaagtccattaatgtttttctgcatttccttcataatatcagtaataatgttcatagtgtgaagaaatcaggtgtgttaatagattgctgcttaaacacagatgtcagatactagtgaaattactttctgtagtagtgtttgggatcttgtatgagactaaattaagaaaaagacatataaatgcatttctcctcaaagcatcaaaaaatgtaaaggtagagtaaaatggtaacatgtttgtgctaaatttatgaaatgccttcagttatctccattgctagttttattgaatgctttgttgtatagcactattcttatgttactatgttttttatttgtcccttttcttttcatatattaattagattttttttcatttgcggtggaccgtttgacttcagtaggtaggtttaactcggttcactctaaattagcttgctgttttagaaaacaattgatttgatgaattgctaagatggatgggggctttgtttgcttttcaaattctccctagccaaaatgaggctttagttaaagtacccagaaaatctaggaggcagtgtgtttgtttagttttaaaataaaactgagtgttgctagagaaatcaactttaaaacattttccctcaaaacacaagttcctgctgcaagccagcatagaggccatggatggggaactggaagttacttgttttttttttgtttttgtttttgttttttttttgtgtgtgtctcctctctcaggcttgcctctctcagatgctgtttagtgacaccttggccacaattttgcaggtgtagatgaaaccacctgattggatttattcaaatcaccaaaataacaaattgattaccatttgtaaaatctactcagataaagccacctttgttagtcagtcctggcccttgtgcatagaaggtgatagggattcacaaaagagcaagaccaatgcaggaagaaaataatctgccttggtctgtatagaagtatctgctgagtggtggttttagtgatggaattatagccagtgaaaatggagaaaaaaatatttttaaaccatagcactcctattcagctacccccttattcgattctgaacatgtatagctcacataattcacccaatatttatttataactatgaggaagtcaggaaaaagaagaggtggacagataatcaggatttaggattaaattggactactcgcagcatttattaagtcccaactgaatataaagcattgtattaagtgctgaacaggccaaaagaaaaatagaaaacataatccttcggcttcatggcctatctaattaaatagcacgggagaggaaataaagatagta[139 bp omitted]ctctactaaaaatacaaaaaaattagccgggcatggtggcacatgcctgtaatcccaactactcaggaggctgaggcagcagaattgcttgaacccggga[134 bp omitted]accatgatattaacatctgggatttaaaatagactgaggatctagcctgggcacagtggcttatgccttaatcccagcacttcgggaggccaaggcaggcagatcacctgagctcgggagttcgagaccatcctggccaacatggtgaaaccccgtccctactaaaaatacaaaaagaattagttgggcatggtggtgcacgtctatagtcatagctacttcagaggctgaggcaggagaactgcttgaaccctggaggcagaggttgcagtgagctgagattgtgccactgagctccagcctgggcaacagagtgagactccatctcaaataaataaataaataaaatagactgaggatcttaaaggaagggaaagacttagttcgaagtgattattttctgatataaaatatttgtttttgagtgatgatggattggaatgaaatgagactgttttccttattgttcttatgtcccatgtatattttcagcccaatatataatatttactaaaacagtcaatactgtcagactattcagttgtttagtttgtcttttcccactttataagtataaatggataagtaaatcaagtattattacatagaatttttcaaatttatagttgtgacaaaatctcttcagctataaagaaatctgttaaaacgttgcaaaatatataattattttattgtagtttctatcctaagatttctatgagtttaaaagaatctaggggaaaaaaaagaattagggactttctttctgactgaaatgatcattaaagctatcgtttagcccaaaatatgagtgctcctgtcttgtaaattttgcatgcttattctagatgataaaagaattgctcagaatcattaataataaaaattatagctcttgctagcatgatcacatattattaaataatacagtattttaattataatcatgttttgaatattttcataaatgggttttaaatttcattgtactgcagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaaggtaaggatatccatgcagtcatcagtatcacactggtagagttctactatgattttttatagaagatgaagtttttgtagcaaggagcattatataagcattgaggaaaatttatttttgcttcaaatcataagttgttttttttttgagacagagtttcactctgccacccaggctggagtgcagtggcatgatctcggctcactgcaacctctgcctcccaggttcaagcgattcttgtgcctcagcctcccgagttgctgggactacaggcgagtgccaccacgcctggctaatttttgtattttttagtagagatggggtttcaccatattgtccagactggtctcgaactcctggcctcaagtgatccacccactgtggtctcccaaactgctggaattacaggcatgagccactgtacctggcctcaaaacattaggtttttaaaaataccatttgggaccgggagcagtggctcacacctgtaatcccagcactttgggaggctgaggtgggtggatcgcttgaggccaggagtttgagaccagcctgggcaacatggtgaaacctcatctctactaaaaatacaaaaattagccgggcgtggtggcacacacctgtagtcttagttactcgggaggctgaggcaggagaatcacttgaactggggaggcaggaggtggaggctgcagtgagctgagatcatgccactgcactccagcctgggcgacagagtgaaactctgtctcaaaaaaaaaaaaaaaaaatatatatatatatatagtttagttaactgttaaagaaatacactgttttctcaactcatacttaaagaataacataactgcttcatgattaagaatttttaaaaaatttattctgtgaaacatatgctttaatatatctttaaatatatatcatatgtaaaatatgtaataagtttttcttcttactgaaaaaaatgttaatgtgatggtgttactataaatagctgtgggtgtggctataaattttacatacgttacactgttgtctatgagtaacggtcacagctacagtttctatttactgcactaattttgttttctttctttttttttttttgagatggagtctcgctctgccacccaggctggagtgcagtggtgcgatctcggctcactgcaacctctgcctccctggttcaagcaattctcctgcctcagcctcccaagtagctgggactacaggcacacaccgtcatgcccagctaatttttgtatttttagtagagatggggtttcactata[135 bp omitted]acattaaatcctgttggcttgaaaaagtagagtgcaaactgtatggatttagaagactctaatttacttccacggtatcataaatcactctaggaaacataatattgtttcataataaataatttatccttttctttttacattccaatataaataaaattatgatgtcatttatcatcggtcattttggaaggctgacttggagcttttattctttttctacggtattcccatttgtcctttttaaacagaaaatgcctgccagtgacatctgctcacattcctttaattacagtgattttcatacatgtaaatcttgctagttttcttcatgtgattgtatcctaaagtagatttaactcctttgctttaagatgtaatttattgcttactgcagtttgctttgtttttgacacattataacatacctccacttagtgtagttggctcagttatgtgccattttcactttttgtgaatgttgatattgacttcacacaaattaactggtataatatatccaaataaaaagatatcttaaaagtcctccagtccaatcaagcttggtcaagcctttaaaaatgcattatcgctgggttctggctaactacttgcttatgcctgtaagtggggaaaaggatcttatgccacgtggaggaaaatgtctttagccatgattttaaatgattcactggaaaagtacaaaatgaacttcccctctctgaagcaaaaagttgtatatttctccactgccttttcacatgaaagagaaagaaaattggattttgccagtgggattctcaccacctagaggcagaattaaatattttatatcacaaatttggacacttttaacttactttttaaattcttagagcagtgtgtgtacacacgcaggtattgttacctgtaaataagttagacactctttgagtgtttgaggttttaaactacaggaaagattgaaatgccaagccttattactctttcaatgacttctgaagctctttcctctttgttcagaggcttcatacaggcattaaatgacgatagagttttctccataagaagtttgtttacttcgtgggcttggttaaccaaagtttcaattctagagtattggatgaggatataaaaggtcctttgtctgttttgtgcagtttccaggcagcctgtgtaagagttcatttatcaaatacatccaagtagagcatgtttcctattaatgatgacaccaaggtgagggattggagggagccttaagccctcatattttccatcagttctctaaagggaccccaaagtaataaaccaaaaaaagaaaagaatgtttcctatgaaaagcctgctttgagactcaactccctaatcatccccaccctttccagccaattgccactcctaagcccctgctcttaggaaattctggagatattgctggtccctgttatgtgttactcataaactatttagcaatatctctctcttttttttttgtgacggagtctcgctgtgtagcccagactggagtacagtggcacaatctcagctcgctgcagcctccgcctcccgggttcaagcagttctcctgcctcagcctcccgagtagctgggattacaggcacgcactgctatgcctggctaattttttgtatttttagcagagatgggatttcaccatgatggccaggatggtcttgatctcctgacctcgtgatctgcctgccttggcctcccaaagtgctgggattacaagtgcgagacaccgtgcccagccagcaatgtctcttgttataattaccatgagacatttttccttttcagaacaagaatgttcaatatctaacatttaccctggggcctgtatagttcttgtacccactacaagtaatgttcatacctaagagaactgcagattctacttctagttcggctgtgggcaaatcctttttccttttttgaaaaagtaatccacgtgcatggtgaaaaacaaaaatcaaaatgcctgtctcccattccttacctccacttaccaattcatctttccagaagcaactactcttgtgagtttatttatacttctattttatataagcacaagcctatatgacatatatgtataaaatataacagaaaccattatacatttttcttttttcacttaacaatacagcctgaaggttagatctaccgcattttaaaaagtagctgcatagtattctatcatatggatatactttattttatttatctaactagtcttctattaatagatacttaggttatattctctgttgtgcaggcaaaatttttaacatatttggcaatgactgtatgttttcctgtgttcctgcttccctgagagaattgtaatttctcttcccctagagatcactcattatcagaactaaaatggactcctatttagaagccataatattaataatagcagctaaaatttattgaggactcactatatgccgaacactattttaaatacctcacattaattgatatcattattattacccccattttaccaaagagaaaactgtagttaagtgacttgattgtaatcaagtagctagtaatgggagagctgggttttgcgcatgtctctaactgcaaaatctgtgctgtcagccactagctatactgccttttaaatctcaacttgggacattgaaaaattagagaaccaccagaaaaagggtaatcactaagtgaaaaatcttg[133 bp omitted]ggccaacatagtaaaacgctgtttctactaaaaagggacaaaaattagccaggcgtggtggtggatacctataatcccagctacttgggagactgaggcaggagaatctctcgaacccaggaggcagagattgcagtgagctgagattgtgcctctgcactccaacctgggtgacagagtaagactcagtctcaaaaaaaaaagaatgagttaagatgattcatggtaactgtattcacatatttaaagggttgccatgcaaaagtagaaatagacttattctttgtagctccaaagggcagagctatacctaggaggtagaacttaggaggagtgtatttcagataaaggaccttcctaatagaacccatgaaacggcttgagttttaaagaagtttaaaaaactatttgtcaaggatacatgtaagggccattcattcctgccttcagcaggaagttggactaggttagtggttctgaaacatttatgcacatcagcatcatctggaccagtccagacctggtaaatcagaatcttctggtggtagagactattactgacggggtactatgttggaagaaagtctgttaagaagggaagggtttttgaaattcacaaatgaagtgcaaatggccaattaacacgtgacaaattgttcaacctcaatagtaaatgcaaactaaaacaatagtaagagaccagtaatcttctacattctacatattgaccattttgccctagagggccttatctaattctccagaaaaacctcctaaagtcatgaaagatagagggcaatgcttgtgctaccacagccactattttctctgatttgagtgtatatacatatctggcgaggaatgtctataagctgaggaaagaaataaatttgtataagaggtaccacattaattaagagccctggtggccagttttatttacatatttacaaatatatcaatctcccaagtcttaaaattgacttaggggaccaagttcatattattgtaattgtagctttaatggaagcaaaaaatgtttcctgaatgaatacagtaacttaccattttttcacttcttccacttactcattcattccttcagctaatatgtattgaccatctgctatgtgcccaggcattggggatgaagcagtgaacaagacagacactgtccctgctctcatgaagctcaacgctcactggagctgaaaaacaggaataatatcatctgctttataggccaacttctattttttacaaaaaccttttacttcatgtcattatgtttgagggatgtaatttgagtctgtatcatggataaatccaaaggccaacaaagttctgtggtaattagttttcagactataagtataaagagattcatgcttcagtaatttgttatggatgttagcctactttttagtctttaaattgatatatgaagccaactccatttatttgtaatatatacatattatatacgtattaagctttcaataattatttttcagaaccaacaagccaaaatagcacaattgtacctcccctttgttggactacttttggaaaatatacagcgattagcaggtcgagataccttgtattcttgtgcagccatgcctaattctgtaagtagtaatgtgtttctgttggagttttatcctattttattgaatgcatttggaattggggtcatatgctatatgatctcaaccttaagagttcacttttttttttttttttttttttgagccagagtctcgctctatcacccaggctggagtgtagtggcacaatcatagttcactgtagtctcaaactcctgtgctcaagtgatcctcctgctttggcctcccgagtggctgggactacaggcatacgccaccatgcccagctaatgtttttcatttttagcagagacagggtctcactgtgcagcccaggctgatctcaaactcctgagctcaaggaatcctcccctctcagccccgtgaagtgctgggattacaggcatgagccaccgtgcccagccaagagttcagtttttactccatgtacactgtttttcctaatacagtgctt[157 bp omitted]gcctcagcctcctgaatagctgggactacaggtgcccgccaccatgcctggctaatttttttgtatatttagtagagacggtgtttcaccatgttagccaggctggtctggaacatctgacctcaggtgatctacccaccacggcccccaaagtgctaggattacaggcgtgaggcaccacacctagccaacagattttaattcaatagacctggggtgggacttgagagcatgcatttctaacaagcttttggctgcttctggtccaaagattgcactttggaaaacaaattccaagagaacaccacaaatcctttgaacgctgtgttttcgttcttaacattttctgttgttgtatggcttcatacatttattcaacttaaactgaacaaaagattctctacttccaagatattaggcactggggactaaactgtattcctttgcttctcctttcccttagtagtctccttcagcacttcttggtgagactcttttagtttatcacaattggtctgtgctttttttgctccccttagaattttaagaattagaaggaactttggaggtgatcagtctcctatttggcaaaacaaccttttgccattgtaataatttaaacattccttctcacattagacctaaaaggttttctatccactggtcttacttttgtcttctagagacacatgaaacacatctgttcccacctccaaatgtaccctttccacttgtgccttctaaatttttctccaagccaccaaatatctccactaatctgtcattccaaatcctttacttttttttttttttttttgagacagagtctaagtctgtcacccaggctaaagtgcagtggcatgatctcagctcactgcaatctctgcctcctgggttcaagtgattctcctgcctcagcctcctgagtagctgggactacaggcatgcgccaccacgcccggctaattttttttgtacttttagtagagacggggggtttcaccatgttggccaagctggtcttgaaatcctgacctcaagtgatctgcctgcctcagcctcccaaagtgctggaattataggcatgagccactgtgcccggtccccaaaaccctttgctttcgtggtcaccccttttccaaatatgcttcagtttaccagtaaccctattaaaatacaatgtccaaattatacactttatagtctgcccagtggactgttaacttctgcccccatccatgttctgtatggcccaagatcacctttgcactttggctggccacgtaatattgttgggtagcaggttaaactgtgtcatttacagcttcctctgcaaattccccctatgaaatgctacagccaatttgtcatgcctgtcctgtgttcctgaggacgttgcttttaagcttttctagtggcttgcttccctgtgactcccagtcatgtcaactggctgaatgtggatactacacctacctgagtgtcaggctggtctcactttacaaatacagtatctcatgcttatgctccctccacatagatttgacagcattatttggaaatatttcacttctctgtattctttgcagctcaagtttccctagggcttctggtcacacaccttcttctagcattgccctggttctaaggaggagaactgaatcatgttaagactttaccaggctgggcgccgtggcacatgcctgtaatcccagcacttggggaggccaaggcaggaggatcacttgagtccaggagtttgagaccaacctaggcaacatgggaaaaccccatctctaaaaaaatgaaaaattagctgggtgtggtggtgtatacctgtagtcctggctaatctggaggctgaagtgagagggtcacttgagcccaggaggttgaggctacagtgagctatgatcatgccaccgcactctagcctggactacacagcaagaccctgtctcagaaaacgaaaacaaaaaagactgtaccagttgcagctgtaccagttgcagctatctagaattatgtcacttggctagaggtcatggttacaacagtatgctagtagctttttttttttaaaaaagagtcacctaaatactaattactagtatctgatttagactttcacagtgagctttgtttaaaatcaatgtaacattttattctgttaattcagatttcttatcctatatacgaatttgtttaaatgacacaggtatcatattctgttacaggcatccagagatgagtttccatgtggctttacttcacctgccaatagagggagtctgagcactgacaaagacaccggtaattaaaccttttggagatgatacattgcgtgggtgtttagacatgtaccctctacttctcagtatttttgatatatttcataataaagaccatacatagcttgatctctactaaagtttaattaaaatctgacttatacttgcagtcaaatttatttgcctaggtttccttgtctaagcttatttagaacatagcttggcatactgagaaaatagaggataatgagaaaaatactggtttccactcttcttatctgtcaccagttttaagccagatactcccatctatgggctcaagtttccttgtctataaaattgtcttttaaattgtgtggctttattttacggcttccaaggaatttcttgtcattttgtacatgctaaagtgttttgaaaggtgaaaagttgcttcacttttacatggtttcttatggtgttttgatataataaacttcacattttagatgtccaagatctattccctacattaatgtctctacttaaattagttccgtactttttaaatatttctgacagttccccctcttgccaacaagggcttgacttttttttttccccagcttatgggtcttttcaaaatggacatggaattaagagagaagattcaagaggttccctcatcccagaaggagcaacaggatttccagatcagggcaacactggtgaaaatgtaagaacttaaatatataggatgaccctagtgacacattagcctgcaacaatttttttatagtataaatatgagcatctgtactcacctgtagtccatcctggctctgcgaaaagcatcccataattcttagatattttagcagtatcttcctatagtggcagctgctacttcaatgtcttaaactatttatagagaataaggcattcatcctcaagagttctaactctgaatatctcctttaaccctagcacgctattttagtgaggagaaattcaagtttaaaatatctaatgtgccttgttatttaaaacgaagcacatcctggcaggattaatgcagtctttcattcttttgtaatagagtaatgatattaatttgggaggaaaaaatataggtcccaaaattgacaatcttagggtcccagcatcacttaatcagaatatatcctcccaactcttctatcaagtcgtttcacgcctaccattaaagtttgagatgtgactgccttaaggcagaaagacctcattttagacgagtaaagttttgccatgttgttatgtaaaatcattgaatcgtataaaattatattagaagggactataagaacaataaattccaactctcaatttacaaatgaaaattgggattatgacttagaacaaccagctatggcaggaccatactcgaacccagattttctaatatgagcactttgtctcctatatcatggtgctcttagtgtacatcagcatcacctggagggcttaaaaaatagatgtctgggcctcaccccagggtgagattcagtaagtctggaatagggcctgctaacatgtatttctaagttcccaggtgatgttgatgctgctggttgggtattgttacccttgagaaccagtggactatacttccactggttccttgagcctttgggtaaacagtaatttattcacaaatgtttctcttttacaccatttagaaattgtgacaacaggtactgtcatagctaaggcaaataaaggtcagagaggttgaatgacttgctagtagtcacatagtagctaggcaagcaatcagaacctaggtctgtttgctccaagtaaaagttcttccttagtaaattccaccctagtcaatggtgcatccccagtttagctcaactgaaagtattagtttttaaattttttagattattgttattctattcatataaatccccaaataagtcagatcttgtcatgcttaatttctgatattttttaaaaagtcattaaataataggaacacatcagtactttgtagaggtactaattttgaagtattattgggtactcctaagtgtaattatcgtaatataattagcccattttttaatttatttatagtttttagaaatagggtcttgctctgtcacccaggctggagtgcagtgacacgatcagtgctcactgcagccttgaactcctgggctcaagcagtcttcctgcctcagcctcctgagtagctaggactacaggcatgcaccatcacacccagctaaattttttttttttttttttttgtagagacaggttttgctatattgcccaggctggtattaaactcctggcctcaagtgatcctcccacctgagcgtcccaaaacgctgggtctacaggtgtgggctactgcgcctggttttattagcccttaagatagattttctaatgtatgatttggaggttggattttaataaactctaaggaaagattcaaatgaaaaagtttaagatgtttcttatgctttcactccatgtaaaagctatctttccttaaatagccatgattattttaaaattttaccactaaaacacatggcatatgagaatgaaacacagtattcatggctatatctttgtgaagactccaaggtaatttctagtgatattactagctattactaggaaagaaagattcagcccattcaccttcaagttgtgatataaaatttagatttatgtttagaattttcccaaacagatctaatgataaaaaaagagttactgagttaaaggctgtggaaaattgtactgatactatttcacgaacatcctgtccttacagacccgacagagttctacaaggagtagtgtatcccagtataaccgcctggatcagtatgaaatcagaagcctcctgatgtgctacctgtatatagtaaaaatgatttcagaaggtgagttaccatcatattaagcatggactgtactagacatacaccctcacaggttcacaaattcatgcaacaatatttgatcatcatctggaggcagagcacatgcacattataaacagttatttggagactctgactttaaaatgtttcttaaattgaacttcaaaataggttcatgtcagtcacacaagttcgagtctttgaaataattttaacataattttgcaaatgaatttctaaaatgaggcaatggttttagaagtgctaaacattttgttttcatgcagagcatttaattcattaaatgaccaatgtaactgaaaggaaataataaccaccagaattcatatttaatacttcagcttttatttaacccaggatttgacaaataagaaacaaaaagacaggaagagttcttgaagggtagggaatgtcatcattatctttgcagcaacactgtatgatattgtctggtatcgcgttctttgtcgggctctgttttttctccttggtatagagccgtatttactagtgtcaccagttcctctttacactatatgatggaatacaaccgaaggactttcataaactgcatgtcctcgggaagtaaaagcaggttatttccaaataccacatttacttagacagttccctcccttctcttccttttcgcaatacttttgcttaaaaaaaaaaaatgcaaaaatggaaaacataaaagcacctgggatcatcatagtgattgctatcttttactcattttctatttttttatttttagtaattatttcgttttaaatattttataataatgcaggatgtaaagacataaaataagttgatatctaagtagctatagaaacattaaaataaatagctagatatgagtaaattctaaagttcattaataaaataaaaataactggaatattcaagttctaggaatgtacgatttagcataaatatcaaacattatgttgtggaatctggaaattgctaacatttatggagtttcttcttaaggcaatgaaaatgttctaaaactgtggtgaaggtttccttagtctttgaataaactataaactattgtaatattgtgggctatttatgtgggcatttttatgataaatgaatctctcagtaaatgtttttttttaaaaagaggcccaatctttatctgttctccactcccattgccacttgactagccttaaaaaaaataggtccaagagatacattagaaaaaaagcagaagtgaacaaaaaagcggttgaataccaccacagcccaaagaatgagggaaagagagagaaggtaggaggaggggaaaagctgcattgctgactagttctctcccctcctccactgtaggtctcacacacacatacacacacatatacatcacattctatactaaccagagacaagtctctggttgttatttttaatgtcatgggtaaaaccatgactgtttttgttttgaagatggagtctcactctgtcgcctaggctggagtgcagtggcaggatctcagctcactgcaacctccacctcccaggttcaagtgattctcctgtttcagcctcccgagtagctgggactacaggcgcccgcca[185 bp omitted]attcttgcaaatgttgaccatgcttgctcagtggcagtactctgtgccgaatattcagtctttgttaattaggttttgtagtcttctgctcttgctttttgattttaaaaagcacattttcaataactagtatacagtctatgtcacatctgtttatcttttatatgtataaagtcatgctgtatatctgtaaagtcatattcattttgttctaagaaatgtcttctagatccttctcaatggatgtattctaattactttgtcttgtccggtaaatattgttttagttactctatatgcatttaaatatttatctctttcaagtccacaatcttgaggtcctctcttggctttcttttttattgagtcataaacagtagcaactttaatgtcaatgaaaagatgttctatctctacacttttatatggattctggagaataaatttcattctctacttatagctgcattttattaattgacaaaaatttgctatttcaaagtcttagattcatttgccaaacattttcaggccttactgcttagtttattatatcgtgagaaaaggaataagagtcaggagttaccagttacgaagtctgaattgacaagaagactgttctgttggaaaagtaaaacattgttgcttccttaagagagaaggtggtggggggcggtgggggggggggtgaggggggtgggggggatggggaagctacttcctctttctttgtgactgtgtcttcacttttctctttagcccagactccaaaaagacactctcagtatcacattgaggcttatcggcaccataccctgcacttgtagattcattaatattctccgaagcagactgttcattggaaggtatctggttagagctatctctcactgcaaatttggtgttagaaggaatagcaaccactgctcttctttttgtactagattttaaagtagagtctaaaggcaagacattcaaagggattattttcttttcctttgcaagagggctatatgaggttatagaataatcctctaaagtttccagtaaactttcagatacatgagttgggtattctcctggggagatagcggaagggttccatgatgtgccaatctgagtttctttttgcggggagacctttgtttcaagtgtcccttttggctggccaatcttgtcttcatgaagattgaaaaaatcttgaaattcatacctcttttgaggactaagtgaagttgttaaaagagaacttgccagtggcttctggctggcagggtcttctatgttaggcttagtgtcattagaggaacttttcgcaaaagaggtctctggcacttcaaagaggccttgactaaaagatggagctggaaactctgaactttgttgcagttcctttgtgctcgtaggtttcatctgcttactttgtgactggcttatcgatttgataggcacatgcctctgccttccttgtgcaggctccctgactgaaaaatctgacatagtcatttgactaccagaaacgaagtcatcactaccagaagtctgaaattgttgttgcctcattattattttagaaagccttttattttcttctcgtaatttatttgtttctttagtgagttccgcaataaagaaaagattttgttgttggatttcataatagtctttctctagcgcaagcctgtatgtttctgtcattgaacagcagtcacaggtttttgcctttaactgatctttcaagtcattaatggtgctctgcaggactctctgctgtttagtcaactctttaattttggctgtggagcccgtccgcctcccgtctgacaatcgctgtttcctcagacttgttaattttgcctgtagacgccgcagctctttatcatggagctcttttagcgccagccatgtttttttaaaattgtcagattccaaatcacatacactaagccgtgatgattctcttcctgaagatttcttacaacctctcctccctcctacaccctcgttccctgcctgcatcatgtttcacagatttggaaatgggagggatggcctcgtcgctcaacaacagtgccgttaagaaaatggcggacttgcagtggattggagctagttcgctgtgagggcgagcacttttacccctttcacagaccttctccgaagctaccttaggacatggggcgagggagatgggtgctcaccgttggacgcaaagtcccaggttttcgctggagaggaggcaccaacttttcggctagaagagctaacccacaggagagggaggccagcaccctcaggcagtggcgcagcaagctgccctttgaccggaggccggaaacgcagggacttctgggggggaacccaagcttctgtgagtagacacccagtggcagataggcgaaagcggaagtcactgctagcttgatatatatttttttaatttaattttttttagatggagtctcactctgttgagcccaggctggagagcagtggcgcgatctcagctcactgcaacctccgcctcccgggttcaagcaattctcctgcctcagcctcctgagtaactgggattacaggcgcgccaccacgcccaactaatttttgtatttttagtagagacagggtttcacgatgttggtcaggctggtctcgaattcctgacttcagatccacccgcctcggcctccgaaagtgctgggattacaggcgtgacccactgggcctggcctaatttttaaaacaagtcaaattttgagtctattttcagttttattcttgatgattagcattttgtaataattgaaacctagcaatattcgtggtcttataaaacaattggaaaattggaagtaactaagtcgacctcccctgttccctcatcctccttgcccctccataaagccaacattgtcttgtcttccatctttatcattgagaggttctagctcagttgggaattaagtcatttgcctgcttttgtgacacctatgcgatttttacagttagaggagggtctgctgacaccattagctccatcaaagtaggataaaaaaggagtggaaagtcaagtggtggcactgtttgttttgttttgttttgttttaaatctcactaagtaggtgtgttggggaagaaatgggtaagaaagagaagtatatgtgatagatttaagagacttttgtgtctgaaatagttgttccacagatagataggacatcagaatttataatgcaaaggcagagagaaaaaggaaagttatctgtctctcctgaagtttaaaattctcttttttatttttattattttttttgagacggagtctcactctgtcgcccaggctggagtgcagtggcacgatctcagctcactgcaacctccacctcccaggttcaagtgattctcctgcctcagcctcccgagtagctgggattataggcgctggccaccacgcccagctaatttttatatttttagtagagaaggggtttcatcatgttgtccaggttggcctcgagctcctgacctcaagtgatacgcccaccttggcctcccaaagtgctggattacagatgtgagctaccgcaaccaggctgaagtttaaaattcttaaacctttttattcacagagccctctgagtagcaggcaacggcatttgaccttctcagaaaaatgcacataaacacaccatctggcataaaattttagggagttcattcaaaacacctcatctaaagtaaaaacacagcaacttcccttactctgtcttcagaaatgatacgaagattgggataagcgacccaaaaggacatacacaaagcacataaaaaggatcattgatgctgaactaattaccaattaaatgatatatttggaattaattcaaaagaatacagagtgtatactgcgcagtgggaggggagaggagaatatagatgaaacaagattcaccttgagttgatagtccttgaagctacataggacttggggattcactgtgctatttgctgtaattatttcaagatctaacactttatttattccattttcagatactctcttaacttactggaataaagtatcacctcaggagctcataaacattcttatacttttagagtaagttatattaatttatcttcatatactttccccttatttggggagaattcaactgttacaattttttctgtttttaatagcttatttgctaataatgtagaaaatgttaaattattttgataatatagagcctgacatagaggttctttacctgcagacagaagaaaaatgtgaacgtggaatactttgtatactgctgaaactctagctaataataaaccatctttaaagcccagcaaaaggctttctgtgatctgaaaaactagaagtagtatcatctgtcgtgcatcattcatttggaacagatgctggattagtggagcagtgtaaatgattggaatttagaatttgtactttcatgtagagctgagtaattctacccactgcagaaatgtgtctgtgtatttgtgtgtacacacacacacacacacacacacacacacacacacgtgtatatgtatgtattccaagactcttggggggaaacctagtctggacatgggaagttgtcctatatttcatcctgagctatttttatatgattattggaagctaaaagaaaaattagagatagaatgaaatgcaataaatttttaaataaatagtacacgtatatgatttgtatgtgcatgtctacaaaaacaaagcatatcaatacaaaacccttggattaaagtcttacaaacttttacggaaaatgtcagaagaataaacagcagttaagatttttttttaactactgtaattgtactgaaatatttactaatgaaaatatctgatgttggggatttgctttagaaacacaggggtagggagggtggagggatatcaggggacctattcagggcagaggtcaaacaagaatagccatgagttcaatcattgttgaatctgggggatgattgggtatgtaggagttaactatggtactctccctacttttgtacgcgtttgaaatttttaataatataaagtattttaatgctattatttaaaatgtagaaattgccccaatttttagt[134 bp omitted]caacatagtgagacctgatctctacaaaaaataaaacattagctgggcatggtgatgtgcacctgtggttccaggtacttgggaggcagaggtgagagaataatttgagcctgggaggtcgaggctgcagtgagccgcgcatgatcattccactgccttccagcatgggtgacagagcgaggtcctgtgtcaaaaataaaaaatgactgatggagacctttgctatgataagttacagagcataaagggtgatttgcattgacaggttttttaaacctgtcattaaaattgtatatgaaaacatgatgtaattgtagcaaataaatgtagaaagagaatatggcaagcccgcaattaattatctatgtatttctgtatagcaaaacacttatcattataatatgatttaaataggctattctttgtaacttatgacttttaaaatatcacttgttaatctgtagaggatgttaatatattactaacatgctattgtttttctttctagagtatgcttgtttcactttagatatatggggaaaagaaacatagcaaggtaattcccatagcactgcaatttctactttttccttctcttccaacagagggcaatcttagtcatgccatgtaaaacctaggttgcatactttgagttaacattgggataccggtgatttagttaacatgtcccaattgaaagtttaaacgaatgggaacttttacattttcaagcttcccaaggagtgatgattaaagtgatatacagagtttctaccttgtgagatgcttatcttttctaaaggaatccagaagaggctagatccaggggaaggcaggaaatcataaagtgaggacaactgtaaggtctgtatttttgtctgaaaactatcaatactcacctcagttactaaagcaaatagaaatccccaacagcaattgggacataaatgatacattatctatttcctctttttgccatgtaagtcctagtgaaataaatacttaaggaaatatttgagagattctaaggtgaagaaggttacttgcttatttcaatgagatgtattttaggggtagagttagtcattaaaggagctcaaaaacagttttaaaaaatgtttaatttttaagaggctgtgtggatggggattactgttcagtctctggaacgtcctaaggataggtagtttgggtggtgagggttccaatttcaaccatgttttcccataagttggagctggtatggccattgttaccatgaacctcagtctctaggattctgtcaactctcccactacgtttactagaggataaacaaactatttcttccttagtccatgtatgacccagttgtaattttttaaatggaaacaacattaaagtaaaacaaagaaaagtttgttcatcttagcaatggacatgcttacagagtaaaaatttctaatccaaacttacctcaggttcagaaacagattagattggcattcattcttgaacatctggctctaggagtttcccctctcatttcaactcttagtgaacctctggctgtcttcttcccactcttgcccttcctcacctcctgtgaaaagattaaatcttattggagtgttggccacttatctctgatgtttttgagaagaaggagggaagtggaagctctttctaaattccttaattatattcatatatgctattttaaagatacattaaaacttcatccagtttctagtgacacttcatttaatccttgagtgtactactatgtttatgtggaaacctaattttttttagttaaaaagatgataacattgagatatgttattagagcactccagttcctgactttaaaatttattttagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagtaagtgaaaatgtgtgtgtggtacccatttgaccttaaagaagtcctggtttaaataataaaaactgaaggtgatggataccataaataccttgatcattacacattatatgcatgtaacaaaatatcacctgtatcccttaaatatgtatgaagaaaagaagtcctggtttaaattgccaatatgatgggaaatgatttcccatacatgtgtttgcatctctctgctatgtatataatcaatttcatcatacatgactataaaatgataaaatacacatggatttttgaacaattttaggtcatgatgttttcttcttagtgttaaagaaactaaatttttcccatggaattgctattctcataatatttttatattgagtattcttcattcctactgttagacttcaatgcaaatattgacatcttaatataatagtatatgtaatatttgtttagttacttttggtcatttaatgattagggaatgaacatgctgagttgactgcagaaatcggtgaatcctaaatactagtttggcaaaggtgtatttcagacaggttgaagtattgacaaggcaaatagggcaaggagagaaatcttgcccaactgcggaagctagagggttatataaatggaagctatcctatgaaaagcaaatattaataacaactcaaagagtgagaatgttttgtttccacacagtcctctgaaggtttcagaaaaggaagccagcaaaactggctttgtggtaagacctagtaataaaaaataatgttttgctagaccctgaactaatagactcaggacctttaaatctgcatgttttaaagccttcagcttcttgtaaaaatatgatgaaccacttccttcagttgcctccaagataccttgttttccttctgatttagaaacaaatgtcatataattggcataattgaaaatgtctgaccatagggcactactgtttatctgtagctgaatttctatttagtggtttctcatttttacccacataattagtggcatgacttagaaggcctcccacattatttcctagttacatcgccagagttcatcactgaaaccttgtctccaaagaggtgggcacctaattatgtcctgcagagctgttgatacagaactgtaatgaaaactaatgaaattgattaacccagactatatttgatgaaggagttaaatacagtatgacactgtgagccctcttttttttgagacggagtctcactctgtcacccaggttggagtgcagtgacgtgatctcggctcgctgcaacctctgcctcccgggttcaagtgattctcctgcctcagcctcctgagtagctgggattgtaggtacgtgccaccatgcccggctaattttttgtatttttagtagagacaggtttcatcatgctagccaggctggtcttgaactgacctcatgatctgtccgcctcagcctcccaaagtgctgggattacaggcatgagccaccgcacccagccgagccccctttcttgtcttaagtctttgggtagaaagtcattcaacaccattatgtgcatcttcgtgttgggaaaagtttaatttacttttttaatcctaggttctacaacaactgaagcagacattttccaccaggcacttcttgaaggcaatacagctactgaagtttccctaacagtactagacaccatatcatttttcactcagtgcttcaaggtaaaaatgaagagttataattcagttggtaccattgcaaagtaacattatgcagaaattacctagtcaatgtggggtagtacactgaaaaaggctggcatgaatagtcaggaaatgtggatggcagttctagtttggttatcatgtgaccctggaagtcactgagactcacttgtgtcatccataaagggaagggagtggactaacttgcccttaagctctcttctacctcttaaattctattagattttcgtatttaaaaacaaagtttccatactttaagtagccagcaatttttagcccaaaatatgattggatctgtttgcccaaatacccattgtgatgagatgtcctgtcagggtagatgatgtccgggcagtctggctggcttccctaggcgcgcacttagtgttttttctcagatgtttgcctctcagtgcaaatcatcattgctatgattttaaaaagaaggtaaaagcagttatctagcaggattattggagggggaaatgggataatggacgtgagagtgctttgaaaagtaaaaacggtgtgaccataatgtaagaactcaaaggtgaaaatcttgcttgctttcacttcagttatacagattttttttttcctttttcccctcttctctaagtaattaagttaattgcttcagacctcgagattttctatggaaacctggcctgtgcttttcaaagaggcttataaaggaaaattgaattagatactaatataaaataggctgcagaatacctttaataaataggctacagatccctttatgaagtattaggtttgttctatattaaaatgcaacacaactccatgtttcatcgtgccaataactaagaaagccattagatctcatgatgtacattgtattccttcctcctattctgatacctctaatttatttaacaaacatttatatagtctcttggtagatatcaggcactgtcctaagtgctttacaaatattaactcactttttcattgtgaggctgggaatgagaaaggggagtgatctttttgaaacaatggaaatgttctaaaattggattgcggtggtcacccaactctgttgccgaatttactaaatgtaatttaattgtatacctgaaactggtgaattttatggtttgtaaattatatctcaataacttaaaaatacaaatatgaactcacttttaatcctcataatagccttatgatgtagatactgttattattcccttttgataatggggaaactggggcccacaggaggttaatgtcaaatagctgggcagtggcagaatcaggattgagatctaggccagttataagagaccatgattctagccactataccatgccttgaaatatactaaggaaagtgccagaaaaatcaaacaccattcagggattctggctgtcagtattatcattagattgttgttgttttgggttttgttggttttggccaagctgtaacctgctggttactttcttgagggttagcaggatagggctggagaaattaaccattgctgattaaaacaaagttgacaaactaaaaggtatttctctacaatttgttgtttctttgcaagggacatttaaacaatttacatagtctgttcaattgtgatacctgttaattatctctactcatagagggcttattttttcacaaatggctaaccatatactaaacatacttttaaagtaaattagatcataatctaataaaatagaactggtattttccttcattcatacattacaatatttagtctctcagaaatacaaaggctgatttgcttgtattcattattaatttattgatttcttaattgagaagcaatatggtataggttaatagaaaatactcttcccatactagtcctgtatattgctgtgttgcattgaaaaaaaatctacctgtttaaaatgttgggattaaatattttagatatcatgtatgtagtagttgtttgagatttccaagttgaaagatggcacaaatattttgaaattatatgcaagagccttttattttcctgaaacttccaaacagtggtttcataaacaggtattggtgaaatcagttctgtcattctcagtggggcataaaccatattttttaatgttttatagacccaacttttaaataatgatggccataacccattaatgaaaaaagtgtttgatatacatcttgcttttcttaaaaatggacaatctgaagtgtcgctgaaacatgtatttgcctcactgagagctttcatcagtaaggtaaggacagaagcttgggagcagccggtgggctctcttcattgcaaaaaggaaagatgggacaatgggggtcattgtggtgacatatacaatgccagctcatgaagccattaagtactgcctttgtaaatagaaatacagaacaacaaagcacacacagagggcctaccatgaaccccctcaaatcagaagctactttttatttcaccccatcataccttcccttttccattaagctcctttgaagaatatcgttttaaaattaccaaacctgccagttctctattttgcttctttttaaaagtattgtcatgttggaggtatataagccatgagtgcactcatgtctaaacactttgaaaggatccaacttttgtaatcccagggtcttgtataatatcttggaaatggtaagcactcagtacatgttcaaatggatgaatcctgcctttcaatgctagccataactgagggccctaaatgtgcagtccacttacctcagctaaacaataacctcagacttggcttttaggaagaaatatgactgaaacagacagcaaagatttattttctgtgctcaggggctttttaaacttaagaataaacataattaaccaagatagagccaaggttatggaaaggcacagtccagatcttccactggtttatgtaactacaataagacaaagaaattcagtttctttatttgtgtaataggctagctaagctttgaaaactttttgccatcctcattatttagatagcagccaattgtgtttaatagatacagaaattagatgaatttgaagctttttattgccattctttaatataatttatgaattaatctatgggaagccaagttcaacacaagcatgttacaaaaactaagggaaagagattcagaactaattcatttaacaaaaactgtaggtacttactggatatagtccctaaaggcttattgtccagtagagggaggcacacacacatcaagatacacatacacagaaacaaataccatcaggataaaataagtctgtatagacctctgggggtgagcaggagaagaactctaatttagcaaaagtttttctgcagcaacggagctaggatttaatatggattcaccaagagatgaaactaaagatgtaaatggagtacagatcatgtggactcatcttaagagttggatttcatctttcaggcatcaggtagtcatggaagggttttaagcagggaagtaacacaattatatttgtattaagagggaattggtaaggactggggaaaatctctttaaaagttgtgttgaagaaggattggtgacaatgtcaaaggcagtaaaaagactagttgcagtaagctagataagaaatgagggcctgaagtaaggcagtgacagtggatatatgaaggatcaaaggcagatgagacatgttgaaaaaggatttacaggatttgatcatcagtccactgacagtatggtggagtgtggtggttgatgtgaaatacaggggaaagactacatttgcagtaaaagttaatgagtcctgttgaatttgagtgcctttgggacattaggatatatggatctttgctctggagagggatcagattggagagccagagttggagtcattctccattcatccatactatatttattgaggaccttctctgtgtcaagtgctgtactaggtcctgtagatacaatggagatacaaaataaatatactctttgccctcatgaagcgttcagtcttagtggggataggggagacagaaaata[131 bp omitted]accccatctctactaaaaatacaaaaattagccgggcgtggtggcgggtgcctgtaatcccagctactcaggaggcggaggttgcagtgagccaagatcgcgccactgcactccagcctgggtgacagggcaagatttcgtctcaaaaaaaagaattcataattattatatgttctaggaaggaaacaaacagtgtactgagacagtaaatgatttgtgggagataatcttatcttagataggtttgtcacttttaaaatgagacctgaatctgtaatcccagcactttgggaggctgaggcgggcagatcacgaagtcaggagttcgagaccagcttggccaacatagtgaaaccctgtctctagttaaaaaaaaaaaaaaaaaaaaattagctgggcatggtggcaggtgcctgtagtcccagctacacgggaggctgaggcaggagaatcacttgaacccgggaggcagaggttgcagtgagccgagatcgcgccattgcgctccagcttgggcaacagagcgagacttcgtcaaaaaaaaaaaaaaaaaaaaaaacacaacaacaacaacaaaaaaacagagagacctgaattattgaaaaggggccagctgtaaaaagagcttaaagaagaactatctagggagaatgacatacatgtgccaaggctctgagttgggaaacagtttgcagtattctgagaactaaaaggctggtatttttggagcatagtgaactagcgggagcatcaacatacaagtggtagttgaagccatgggagtggtttgattttccctggagggtacattgaagaagaagaataacaacaacaacaaaaaaaatcaggagcagaacattggagagaaacaacgtagaagggaggttcaaagacgaatctgtaagggagatgagagggagcagtcacagaggtgggaagaaaggtaagaaagaaggatatcatggaagccaaagaaggaaagagttccaacattgtcatgacgtatacggagtagtcaaataagaaaggagaaaagaggtctgttagaattggcaattaggtcattgatgattttagccattgcccactcagagaagtgagtgatgtgggtagaagacttagtgtagtgatgagctacactatagctatgatctcccttaaatgtttattttcataccagagtatctgcttcatccagagttagtttagtttggtgaaattattagcgagatttcccaattcccaatcagaaaacatttattaagcattcattatctgcatagaattacacttggtattaaggtgaaataaagggtagattcctatatgtgggtctaaattcaaggttcctaagaaataatttttaaaagatgtccctctagcttcactctctgaaaaacatctattgtgtatcctgaagcagcttgttatttgcttgcctagacctaaaagcatgggaaattgtaacaagtctgttacctgtatattgtgtcttccacaaagcagactgaatacattcttaaaggaacaggccacttgtctcttttgataattagtcactttcttactccttttctatgctaaaatgtatcttaactatcagtgtttatgtgaagaggatatgtgtgtgtgtgtgtgtgtgtgtgtgtgtgtgtgtgtgtgtgtgtgtgtatctcctatatcccatttgttaaaagatgaacttcacttgctgagtagattttagctataattttctcagcacgttgatgttcacaataaaggaactgttgaaatataaagcaaaagagtaagtaatgaaaattgaccttcccatttttaagcccccatttgagacccatcattcatcatttcaggcattctttcaaaacatattgagaacctgcttactgtattatggcggtgcaaaagtaattgctactatatcactatatagtggcaaaaaccgcaattacttttatatatattatattattatataatatattatataataatataatatataatataatattatatattatatatgttattatatattaatataatatattaacatataatatatcttatatattaatatataaatataatatataagatatattatatgttaatatattatatgtttatatattatatattaataattattatataatattatattataatataatatataataatataatatataataattaatataatataatataatatataataatatataatatattataatatataataatatataatatattataatatataataatatatattatattattataatataatatttaatatatattataatataatatttaataacatgtaatatataatatttaataatatatcatgtattatatattataatattatatataataaataatatattttataatatataataatatataatatataattatatataatatataataatatataatatattattataatatataatataaattataatattatataataatataatatataatatataatataaattgtaatatatataatataaattgtaatattatacaatataatatataaattgtaatattatataatataatatataaattaatatataataatataatatataatataatagtaatatataataatataatatataatattataatattatataataatataatatatatataaaagtaattgcggtttttgccactatatagtgatatagtggcaattacttttgcaccgccataatacagtaagcaggttctcaatatgttttgaaagaatgcctgaaatgatgaatgatgggtctcaaatgggggcttaaaaatgggaaggtcaattttcattacttactcttttgctttatatttcaacagttcctttattgtgaacatcaacgtgctgagacaatatattattatataataatatattatattgatatgttaatatattaatatgtaatatatatatatttatatatttatatataacataaattatatatattatatacatatatataaatatataatatatataatatattaatatataatatataatacatatataatatataatagatataatataatactataatatgttgcagactctcgagctcttctcagatctatagcatttatattcagtacttctacatctttgtaataacttatatactgacttaagttctattattatcacatgctggtgtttatgttaactagttcaggctctctggagagcagagcctgccttatgttgattttgtatcctcaaagcccccagcatagttttaggtgaggatatagagggcacttgatattctattgattttatgattggattttaaatacttatttctgttttccctgttctttagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacaggtcagtgaaaataaaagcgcctcttcatctttcttctcttcaatctttaacctctagatcaagatccagagccacccaatccagtccaatacaatgtggccatctagcacttgatgtgtggctagtctaaatttagatgttctgaaagtgtaaaatatactatggcttttgaagactaagtatgaaaaaaatagaagatctcaattgttttatattgattatatgttgaaatgatatgttgcctgtattaggttaagtatattaaaataagtctctttttagtgtggctactaggtaattgataattacgtatgtggcatgtgtcatatttctatggaatagagctgctcctgagcagagaagagcataggctttatttcaaattttattttattttattttattttttgagacggagtctcgccctgtcacccaggctggagtgctgtggcatgatctcggctcactgcaacctccacctcccgggctcaagtgattctcctg[134 bp omitted]taacctcccaaagtgctgcgattacaagcatgagccaccgtgcccagtctctagtttaaatttgaggactgccacatactatgtgacctggagcaagttacttccttagcctctcagtgcctcagtttctgcaaatctggtggggtaaatattgttacctagctcataggatttttatgaggattaaatgagatgattaaataacaagcttgttagattttacagaacagataacacagtttatgtttttcatgctccagtatgcccacttattttaaaaatgagagatgtgtcaaggtttagtggaaagcattgactttggaatcaggcctacctgcacttaaatcatagcttaaatccttacatgccctgtgaccctaagcaagtcactcaatctgactgaacctgttcccttatttgtgaaatgagactgagtatttcactttgcagagttaccctgaggattaaaataaggcgtgtatagtgcctatagtgcctgacacaatgtgtagcacaagatagatacttcctacatgatagttattattcaacatctccatacttttgggtttattggatgaaatagctctgaactaaaccacaattgggactgcttgactcagtagccttcattgtaatatgggaaatccttggtcctatttatatctttactgtcatggtctgtcccattagagttgtttactggagataagattattagtggggaaacaaccataagcagcttgttgaaaaatgtcatcaataatgtgaaaatctaataggaatactgtgtatgcttcctgtaaaagtctgctatataattacttttgcatgttagagtcagccatcattacacattaggtcctttactatttgcttttatatgagatggcatttggaaacccaccttcccctagaacattgttctaatttgtgtgccaatatacctgaaattcccccattggtattgattcttctgggtcaaagcatcagttttctttaagtcttttattcaaatatagacaaattaataaatatgaagacttagaacactgtctggcacataataagtgctcaataaaggattaactagtactctaatggttatgatctctttcatcctctacaaagtagggatttttatcataggcattttacagatgagaaacatgaggcacagaaaggttaaatagcttttccaaagccacacagtgaattattgataaagtcaagatttgtatctaaggcattcaactctagagcccatacacatggctattactgtatcttgcttcctaggaccagtggtaaagcatccagccattaacatcttagtatgaattgttttggcattcacccaagggagactgagagatttaaaagtcccatcaaagacagtggttcatgcctgtaatcctagcactttgggcggcataagtgggtggatcacttgagcccaggagctcgagaccagcctaggcaacatggcaaaatcctgtccctacaaaaatataaaaaattagttaggtgtggtggcacacatctgtagtcccagctacttgggaggctgaggtgggaggatcacctgagcctgggaggttgaggctgcagtgaaccagtgaaccaagaccgtaccactgcattccagcctgggcaatagagtgagaccctgtcccaaaaaataagaagtaccatcaaagtccattccataaacttctgttaaactaggtaaaccctggtcaaaaacaaagaaagttgctgaggcactggacttggaagtccagccaactaaaatagactagtgaaaaggaatgagaaatcatcaaagaaaaacatgatttattctcacctttgccacagctacaacctagaaagcatatttaaaatggagacctgactaccattgtatcagttcactattatgaaaatagttttagatctggctatgctatgagttttgaaaaattgtttacgtctaaccaagaaagatcctttaaaatttgaaatagggcctttcaagttactatttcagcagaagaatgtaaacccctcatgtatgaagggtacattatgatggtacagtgtagaatctttaaaagaagcatttcatgtgagtgcttatatacttataaaatgatgagcatagacagcatttgttcaaaagttatttggaaaataatatttacttcttcccacagataataattgctgtaagccaactgatagctgatgtagcactaagcggaggatcaagatttcaggagtctttattcattatcaataattttgcaaatagtgacagacctatgaaggtatgttctcatttcagataataaattagaaccacctttgctatcagggaagtttaaactcttaaactgtcattggattcacaacttttgttagtatagaatgtacggaatgtgagttttatgagttaagggctttgtcttatacatcactatatctctagtacctagaacactgcctggtacatagcatatattcaatatcagtttagtggatggatgaatgaatatactatgtattcatagttgttatggcaagtcgaatctgaattttttttttctgggcttcatttccaaacttgctcagaaaatacatagatcctttatttcttaacaattgtcaccacttttaatattggttaaaaaagcactgaatttgaaatttcacaaaatttcacttagaatagctaacagttgcctgatccattgccaatggatgagaaatggcacagaagggattcattatttgatggttttgtgagttttgaaaattatctgttaacaccaaggctgtcactcttaagcaccattttgctgaggccaaacccaagactctgaccactgttccactttctttcctatatgcttaaaacttatagcactgtaaaaattcatctgttgctttgttgcgtagagtgcaggttctgatcttcagtgacacatgtatacaagggaagaagaatcctttgccaataggacttttcctcccagaagaatgaatcatccccattcttgggaaaggtcatcttccagcacagtttgacaacattgtgtaaaatctgaaaaagattaaaagctcatagtcacagcatatttgatgtttggatgtgtagaatctaagtaccaaaaaatattcccataggaatgttgcttgtactgaaaaataacagcgtgtagtgccagccgctctcaggctgggaaagtttgctttccagccagttctactagttccgcaggggatcagtatatgctccagctaatcttgtgagcatagaaacaagttacaccacttatgcttatactctaaggaattgtttttaccagttgttaccatccttagtactatgttatataggtagattggtaagtttttctaggtaaatggggcttgtatattctctccttgataggaaatctttttcttttccatatctcatttatgaaatgacttagttttattctgttatggcagtcattaccaacaaaccctattacgaaaagatacagctttcccctggtaaatgggatctctattaatgtatagaaaggaactttatgtatataattattatttttaaagggagtcaaagccaggtaggtattttttatttctattgtatttatttatttacttagagacggagtttcactcttgttgcccaggctggagtgcaatggcccgatcttggctcactgcaacctccacctcccaggttcaagtgattttcctgcctcagcctcccgagtagctgggattacaggtgcctgccaccacgcctgggtaattttttatatttttaatagaaatgggatttc[131 bp omitted]ccacatattgtgtttatattgacaagctccctaacccctgtacctgtctcttcctcatcatctctgaatcatatagataattgtgattactcctgtgggggttaagaggatgcaataggacttccttagcagtggctagggtaaagaggaaactctggtattcttggtgccaaaaacaaactttgaaagcttaatgatctctctaaactttctggaacgttctgtgattcatgacctcccatttgtgtaaacagaaatttctgcagtatggttttcaccttagtgtatgtggtagttagtggatggagtaggcatgcttatcagaatggaagagtggccaagagcaccagctctagggccagactgcctgggtgaaaatcctgtctctaacatttaccaattttgagactttggtcgagcatttaaacacttttttataatagtgcttaactcatagggttgtcgtaaaaattaaaacatgtaaagaacccagactagtgcttggcacatagtaagctattagtttttagttactgttacaagaaaacggcaaacaaagatcactcccatggctgtgcaattcacaatggaggatctgggattcaaagccaggtagtctggctccagagctaatgcttttatgtcctgtgaatgtactgccaccaaggttagagcctttgaagcctgggctagttacatatttaaaaaataatttatttaaaattatttcagtgtactatatgcaataccaagaactgtaacaggaagtgaaaatcatatgtcctcagcattggatgacaagccttagagcacatcgatattgttgttcaacttgtcttttttgtttgttttgaaattaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggtgactacttaaagttttgttctaaacagcccttcaaaacaccttgagcatgttctgacagttctttctctgtcatcctttttcaggctgcgatgtgttatgtccatgtagcagctctagttgcagagtttcttcatcgaaaaagtaagatatttctgtttttagagatggggggattttcatttagcataatagttttttatctttgtagtttagctatgaatatgatataatagaacactgaaaaatatgttcacccttggccttattcagtgttaaaaataagctgttataaaagaagactggattgtttgttgtcccttctgctttcattagagattacaagaaaagttaaatagtacagggtggccaggtgcagtggctcttgcctgtaatcccagtgctttgggaggccaaggctggaggattgcttgaggccaggagtttgagaccagcctgggcaacagagtgtgatcctgtacctattttaaaataaaatataaaatataaaaaaaaaatagtacagggccaggcctgatgcccagtgtttattttccaagactgtccctccctggaagactgccacaaattaaactcttctcaaggctcaagtcgggataacacagattatttgtttccccgtcatgtgtcttaacatcaccaaactgcccatagactatgtctctccagccactttagtgcagtgatacctgggtactaaaagggagtcatactcttgaagggctttaggtccagcagccctggattcctaatttaagattcctaattcaggaaatctacttggaagtgtccctttccataaacagtattgttggctactgctcaacagtattgttgaacaaactgcatctgctcaaatagtaacccagttgagttaggtttaaacattgattggcaatggagctggcaaccaagaaatctctatctcaatgtccaagctacttcctttaaggcagtggaatgagtaacaatacggcaaaatgaaaccaacttattaaaggagtcatatcactctggcttcagctgtacgaacacaaccatattttgttttattttttaattacagaattcctacagttaactgtatatctatcatttcacactgaggctcagtgtttgattgcctcatataacacccatgtggagaatctttttctaaaaagattcttggccgagtgtggtgactcagacctgtaatgtcaacactttgggaggcatgggtaggtggatcacttgagcccaggaatttgagaccagccttggcaggaatggtgaaaccccatctctacaaaaaatacaaaaattagctgggcatggtgtcacatgcctgtggttccagctacgaaggagggtgaggtaggatcatagcttgagcccaggacactgcacttcaacctgggtgacaggacaagaccctgtctcaaaaaataataaataaataaataaataaataaatgaataaataaattttttaaaaaagattcttcttaagtaaaatgtagattcattttacttatattttaaattaacactttctgtctgactctggaattcttttgaataatctatgtgtttgatatactttagttttctccttttagtatacatatgtgagttttaaacagagaaggagattaattaccaaaataaggccccatttgagggtttttttaaaaatcactggtatgcatatgaaatcacagtataagtaaatattgaaattacacacctgaaattccaaataaactgacaagatatgagaaccttaaacggagtaccgtgatttcaagtatgtcttcagagaaatagattaatattatctcatctttttaattagaaatctggccaggcatggtggctcacgcctataatcccagcactttgggaggccaaggtaggtgatcacctgaggtcaggagttcaagaccaccctagacaacatggtgaaactccggacgttgtggcacacacgtgtaatcccaactactcagaaggctgaggcaggagcgcttgaacccaggaggcggaggttgcagtgagccaagatcacgccactgcactccagcctgggcaatgagaacaaaactccatctaaataataataatagcagtagaaatctgaagatttttatgtccactaagtctaaaactgtactttttagactttgaaaatagttaattatattaaaactatttcctggaatgtttttgtttttttcacaagtgcagagacattaaagctaagcaaaaatcaagaattatttgtctttattatcagtccttaagctttagaaatataatttcttgctatggtttttctggatattagcatggggcagctagcataaacaccaaactgatacatttcaggaagtggaaataatattttcaactagccatttatatatttcataataccctcaaggtttcttagaatttattcttcatagaaatcaaagcactcttcactaatgaggagaaaatgttgttttgaatgttaaaaaaaatgatgtttaagagaatttacatatttatttataggtgtcatctatttttaaatttcttttaattaaattttattttattttaagttctgggatacatgtgcaggatgtgcaggtttgttacataggtaaacatgtgccatggtggtttgctgatgccatctatttttaaacctggaaaattctatttgcctaaattagaaaaccttattctaaaatagtggtagtagtaaaagtcctcagggttttccccacttagcttcagtgatccaaaacaccttttttttcttaattagctgattcaactatgctagctataccgaggtcgactaccaatttaaaacacaagttaaaaacgtaaactgagtattattctaagtgaactaactcaggaatggaaaccaaatattgtatgttcttgcttataagtgggagctaagctatgaggatttaaaggcataagaatgatataatggactttggggactgggggtgggggccagggaggaattaaagactacacattgggtactgctcgggtgacaggtacaccaaaatctcagaaattactgctaaaggacttatccatgtaacaaaaaatcacctcttcctccaaaactattttttttaaaaaacctgtaatctgttaacctcccatccattctgagaaagcattagtgagctttttgaagtctagataagacccggcagttgacagagtaaatgaaaatacatttgagtgcagaactgaaaaaaaatcattgaatttacacttaagaccaacgtatttgacaaagataattgggcacctttagaactctttgttttctatcattaagtgccctttgataatgaagccaagagggaaggagcattagagtatattttaaatccctgatacatatccattgccaaaaatgttttgttttctctaattcctaaccagtttctcttgaagtacattataaaacatttttaaatcaagatggaataaaatactactcatcagttgacacattggaagcagatgttctactgtgtagcgtttttaaggaaaaaaaatactttgccctattggatcattgcctaagcagggaagggcttaggggcccttgcccctcaaaggtgactgcacagcacccacaagggaccatttccagatccttttcttcactgtgtcaggcactgaattgacaggaaaagggaaaggaggtatgcagtactccctgcccccaccctcaccctaccctcaaacttctttcaggcagcctgagctcttgcttgttctaccaaagagacttaaggatcactattctcttccctttattgaaggcacctcaaagtgataatactgagtgtcagctattctccttcctcccaaaaaatataaaataaaaaatgtcagaatttgcttatttttattttgtttgagaacctcaaattttctagatcacattctcccttttttcttttcctaagagagggtacaactgttttccccagggaagacaagagtcaagtctctgcattctttcaccaccaaatagcatcctaggttcagcaaagcttcaggcctgcaaggattcacccatcaacccagaaaaaggaatttcctttcccatagaatctggtttttttcattccttacagggtaatgttgctctctttcccaagacgtggtatccaggatctgatagcttgagtttcatgaagctttttattccctcattctttcctagtcatagcttttccccttcttatcctcccctcaggactcttagctcttatccttcttctgactggccatcctttttaatcaagggttgcactgctatcccatcttccacaccccttcccactttttttcacgggataacttggattcagggttatggtctctatctgaacagtttccatcttgctttccctagaacagcagtcaggaatacagaagttacagctataaacagcaaggtcaagagtcctggtcaaataccagagaaactgatagcagactctccaggaccaccttctacagggctgcataggtctacatgagatccctcaaacagatgcatccttctgttgggatatgtacattggccaattctagactcagcaacttgtttcatctgaaaatctttctagaactaagaggaatcaggattttctccaagcattttaaagattctaacaaagggtcgtgatgtaattggatattgatgggtgttgataactttagcaaaaagggggaggaatatagtcatctctgggtagagatccattatcaggcagatgcattaagataacacacttagcaagaatattggactctgaagctgaaaattcacaatagtagtctttgcactagataacccagacacgactttcaaaagtgggtgtttatgtctttgttcctgagataaaacataattttccctacttctacttaagatacaccggaagactctagcaagatgcttttagcctcatctcatctggcataggagtgtgcctttcttcatcctcccttaaatcccagcattctagaaaagccctacatttggaaatgacttaaagtaataatctcttttgaacagatgggaattttttttctcccagtcatggacctagctgcctgaggccttcagggattcactatcttcttcaataaaggctatgttctttgtctcttcactcaagtcttgggccctcttctttacggcctggctcttgacctgatagtgctgatcaagtgggatggtttcttctacatttcaaaaagttctcctaatgcgctactgcacaaagagtatcccacagaccagctgctagtctgagaactatttatcacatgtttacaacaagataaggagtattgtcctgaatgtaaattaaccatgtcactaaacactctgtttgttcaactgacttgttccttttaatagaaagactttgttgaagaaggaaatgaggaattgatttacattctggtgaaagttccttatctttttatggtccagtactttgaatagaactctctagaggtcttgtaacagaccattttaggcatgcttatcttcagaaatgaagcaggctatgttttatcttcagcgccttttatttattattattattttttgagatggcgtctcgctgtgtcacccaggctggagtgcagtggtgatctcggctcactgcaagctccacctcccgggttcacgccattctcctgcctcagcctcccgagtagctgggactacaggcacccgccaccacgcccagctaattttttgtatttttttttttagtagagatggggtt[145 bp omitted]tacagcttggtgggtcaaagtaaatatcactttcattcctggggctccttcttccttaattaaaactcactgactactcccatgtatttctcccttcttgaaaaagtatttcaaagccaggcgtagtggctcacgcctataatctcagcactttggtaatctgagatgggtaggatcacttgagctcaggagtttgagaccatcctgggtaacatggcaagacctggtctctacaaaatatataaaaatttgccagccgtggtggcttgcaccagtagtcccagctacttgggaggctgaggcagaaggatggcttgagtccaggaagtcgaggctggaatgagctatgatcacgctactgcactgcagcctaggtgacggggtaacactctgtctccaaaaaaaaaaaaaaaaagtatttcaaaataatcctatcttcccctagcagactttcatctttctctcaaagaagtgtggttcctacttctgtgtgtggttcctacccatgttctgttaagcagcttacccagaagatacatgtctagtgattaggtttcatttagacaagaagagttggaaaaatccaagccctgatatataacctcttttccaccagaattctgagaaatctcttcaacatgaggtctgattttttttttaaaccttccttcttccttccccaacctctaacaggaagattaccagatacttaattgtaagtaaaggtcattatttgtaagtatcactgttaggttgtagaacagtagattgcaacagccatttttttgtgtctgtgtgactagctcctatcagaaggaaactttttcattgaaacgttttcaatggttatgttataaagaggcagaattttccttgaactctaaaattacagcccacttagataaaggtaaaggcagacacagtaggaatgtttacacatgttcccctgtctagaatctataggggaaccatgtggcctttacacctcgactgttgcttgacagtaacaatttggtccagaagcctacagcaggtgttctcagcttgagttcacttcctacttcccaggagtccagctggcagccattattttattctaccttgagaaggctagtttatttattggtaggcttatttgctagtaataattcattgagtacttatttactaggctccattctaaacactttacatttcatttaattctcatagcatagttatttattatccctgttttacagatgataaaactttttatagtcccagggagataaacattagcacaaaatcacacagttagtgatagagctgagtctatgtaactccaaaagtggtggttcttccagtgccccatcctgttttctctaggatgcttcatccctgccatctgttttatttcctgactctcttaaaagtcctaggccagaccttctccaacatctcacttcctctcccaaatctcagtgaaattaggcactagacatggttaccaaagatcacttagtggttacctgaaaagtgcctgccctcttgtttagatgatagaacacaaatgtatacaggatcaaagtttaaataaaaatgtttagattgcactaggtaaacatctatcctagccattgaagatgatacatagtcaaagaataaaagttattcataactaacttaagctcactttgtagggggagaaactaataaaatatgtagcaaatggaaacaaatttaaaaatttttgtaagtgaaaattgtacttaagactttgattcttacaaaaataatgtgtttattttaaatagcccatctctgtaaggctcactgttatttactaaatgctttctcataaattcactccactgttttttttattcacacagaattatttcctaacggatgttcagcgttcaagaaaattactcccaatatagatgaagaaggagcaatgaaagaagatgctgggatgatggatgtccattatagtgaagtaaggattccagggcctgcattgccagttatataaatttcacttcttaaaattcatatatattaaacaattattacagctaacctaattttgaaggtaactaagggttaatgaactttaagtattaaaactgtccagggcaaagatgttcctgtttagagggccctgtctcttgaactggtcccattgtctagttttagaaatacagcatttgccgtcctcaagtcaccattccaataactagataagagtcaacacatgttggaaatttttccataaaaaatagagttaacattgctctttacttcaactaagacagactatgcacaaaagtatttttaaatggaaaatttctgctctaaacaccacatggatagaaaacagctttggctgtcagtcaaccaccaaagatttattgaacattgacttaacagcaaggccttggacttggtgacctaggagctttaaataattaaatatgattagtccctgacctccaaggtccacctgaagagataatacatgtacatgaaatggaaaaaagacttttgaataatatttgaataatgcagacaatatgtgccatgcaaagtcaaaggtgaaagatgccttagagctcaggtaaaataaaggaagtatgatcagagagggattggaagaatgaggacaccctgaaggcatcctaagagacaggagaagggcagggaccacgactaagaggtaggaaagtgtaagacatgtttgaggcacagtgagtggaagtggatccttttggctatagcagtaggttcccatagagaagagtattagttgaggccagattttgagaaactttcaatgtttgggctttattcagtagaatattaaattggcatcaaagtcttttttttttttttttttttttatggagtctcgctatgtcgccaggctggagtgcagtggcgcaatcttggttcactgcaacctctgcctcccgggttcaagtgattctcctgcctcagcctaccgagtaccagggactacaggcgtgcaccactatgcccagctaatttttgtatttttagtagagacagggtttcaccatgttggccaggatggtctcgatctcttgacctcatgatccacctgccttgacctcccaaagggctgggattacaggcatgagccaccgcacctggcctcaaagatttttgagcaggatgatgactacatgaaagcaaggaagagggaaggctaatttggtgatgatgtgggagatgtattgaagatacagggataggagctagaggcaggggctagagagaaggctgccctaattatccagatacgagtagttaaggcttaaaccagggtagtgaaagattcaggaaatagtgtgaggaaaagatgctgatttgctggctgtgggaggggaagggtcaaaggtagctctaagatttcaggtttggaggttaagggaaaatgatagatggatggttttgcaggaaaagtgatgaatttcattttataggtgagttgattttgatgtgaaagcttatcaaaatggaaataaccatcaagccattagaaatgtggaactgaggctgggcgcagtgtctcacgactgtaatcccagtactttgggaggctgaggcaggtggatcacctgaggtcaggagttcgagaccagcctggccaacatggctctactaaaaatacaaaaattagccagacgtggtggcacctgcctataatcccagctgctcaggaggctgaggcaggagaaccacttgaatttgggaggtggaggttgcagtgacccaagattgtgctactgtactccagcctgggtgacaaagtgagactgtgtctcaaaaaagaaaaaaaaaagaaatatgaaactgaatctaaggagagagattagggttagaaatacacatctggaagtcatatccttatgaggaccaaagcagactgaatgttagacataataacggcaagtgaagaccggagaatcaaggactgaaccatgggggaaaagttcacaaagagtgtgaacgtagaaaacaagaaagaaacacagaaaagagattgaagttacagtcccataaaattacatttcttaaaaaaattgtattaaacaatgagatgaaaattacagtgacacacttcataaacactttatgaattgattttttaaaatacacaaatctcaacttagctctggcttatttagttaaattaatgatacacctagaagctttacctactatttctacatagtctgtctccctatcagtaaaataaggacaataatactatcgtggtcacttcacaatacatgcgaaaacttaaaaagtcatgaagtgtgagaataatgtcaggttttatcattgacctacttggcagtgagatttcttaaaagcaagttggtgtccttttaccctcagaacctacaaggatagatacttaaaatatgtttgttgaattgattgatcataacagagatgcaagatacttgaatttttattccagcttaatttttgactgtatagccttggacaagttaattcatgtttctggatattagttagatgatttcccagagacctgcaggttttacaggctgacagcaggaagattcagaggatttcatggggcttaactggttcagtacaactgaacttatatccttgccttctaaacagcagcttcagtgtattcatagaaatggctttgagcttgacccttttttatactcttaaggagagcaataacttttcttaataatcaaaaactgtaattagttttctgtataaacacatttgttggaaatcttttgggttctacaagtaatttatacatacttctatttgatatatacaggtagaatcatgttttaccaagtgccactttatttttcagtttgcataataaggcttcttccttaaaccctagccaattaaaaaaactgacactgatttagaagttacattgaaatgaaaaatacaaacagttgtccatttagtgcttgtatttaaatatgtgagttaaaccggtaataacgcaatgtaacttgtttccaaaaatgtatttctgacttgatttgcaacagttttttttttctgcatgacaccacctcaggaggtcctgatgacgtgtgcccctgcaatcgattttaaacatataattaatatataattgggctgggcgtggtggctcacacctgtaattccagcagtttgggaggccaaggcaggcagatcacttgaggccaggagttcaagaccagcctgtccccatggtgaaaccccgtctccactaaaaatataaaaattagccgagcgtggtggcacaggcctgtaatcccagctattcaggaggctgaggcacaagaatctcttgaaccccaggggcagaggttgcagtgagccaagatcgtgccactgcactgcagcctgggcaacagaacgagactgtgtctcaaaaataaaaataaaaatgatataattaatatgtaataaaatcttaaacaatttgatgaattttgacagttgtatacacccatgtaacctaccatcagaaacaaaaaatagaacatgcccattccttcgggaaaggttcccttgtgcccatttccagtcaggctccccacctccaccatctgatttctatcaccatgaattagtttttatggcataaaaatggaatcaatcattcaatatgtacctttttttaatctggcttctcttgtttaacctaatgtttttgagattcatccatattgttgggtatatcaaaagtttgttctttgtctttatatacaaattttaaatccattcagttgatggattttgaattgtttccagtttcaggctgttacgaataagtctactttaaacattcctatctatgacttattgttgacatatgctttttttctcttgggtaaatacctaggagtagcattgctgaatcctagggaagatatatgtttaacttttaagaaatttccgaagagtttctcaaagtggttggaccgttttatactgtttgccagtagtagatgagagttctagttgccccacatcctccctagcatctgatattgctgatctttttaaattttagccattctattaatattaggtgtgaatcaacatctcattgtggcttttatttgtatttccctaataaccgatgatgtctaccactttttcaggtgttccttggcctcttttgtattttcttttgtgaaatgtttgtcttttatccgttttagaaatcacattgcttactttttattgttgttttgtgggagttctttcctggatataaatcctttgtcaagatatatgtgctgtatatttctttaccagcttctgacttgaccattcactttcttaattgagtctgtggttgagcagaaaattttggttttggttgtaattgatgaaatccagtttattattttataataatttgttctttttgtatctggtcccaaaaatctgtgcctacctcaagatcctgatagtgttgtcctgtgttttctcctagaaacttgtttccgagttttgtttaggtctataatatatttaaagttcatttgtggaatgaaatagaggtcaaagctctttttttaagacagttttttttttttttaagacgtaccatttggggaaaaacaagactttccttttgtcacgttgaatttactttggcaccttggtcaaaagttcggtttttcatatttgtgtgggctatttctggattctcggttctcttccactgatctatttgcccatcttgatgccaatatcacacttgattactataacttaagtcttgaaatcaagtagtgttagccctccagctttattctttttcaaagttgttttggctattctacgtcctttgaatttccatataatctttagaatcatcttttctacttcctcaaaatagcctgagaatggagagtttaacaatattgaatttctcaatcaatggacatttatctgggttatctttaactgccaataatattttgtagttgttagggtagaagtcttgggttagatttactggtagatatgtgatgttttgatgctattgtaaataatattgtttgcttttatatttttattttttattatgttgttgctagtatatagaaatataattgattttgtatgttgatcttacgtcctgcaaccttactaaatctgcttattagttttcatagtttgtatgtcttttatgattttctacatatacaattatgccatatgcacggaacaattttactttttctaatcctgtatgctttttctctttctcttgccttattgtactggctagaaccttcagcataatgttggatagaagtggtgagagcagacattctaacttgttctcaatcttaggagaaacatgtctagcctttaaggtttttagtaaatgccccttatcagattgaggaagatctcttctattctttgtttcttgagttctttttaaatatcatgaatgggtgttgagtgttgtaaatgcttttttcttgcatctattgaaagagatataatttttcttttttattcagtttatgaggttgtatattacattgttttttttttctaattgtaacctaactttacattcctgggataattcatactaagtgtgcaccttatttttaattcccccaatgtttgtcccaaaattgctggaaattttaatttggctagcagatgttaatatacagatgttttattcaagtagcaacatttatttcacatatactatccagtgacactaaaataattactggaaaagccaatgtaagtaaaatattgtccctactctcaaagaatcacagcctattggaaaagtcagatatgtagataatacgtaaataatgtacaaatatagtgataaatctttgccaaaaaagtagtgaaatagaaaaaaagatgtgtagtgtcttgcctaccctatattgataaggagaaggatcctggaaaaggtgatacctaaagtgttttaaagagattaaccaagtagaagggattaaagggaggaggggcacagcctgaacaaagacataaagctaagacacaccattgtgcttcagggaaactgctagtagttcgctgttgttataacataaagtacaaagtttggtatgatgaatgatgagattatggaagtatcagccacatcattgcaagctttatgtgccacatgaaggagcgtgtccgttgttctgtgagtgatgcggagccattgccagattttaagaaagggagagtggcacgctcaggtttgcattttaatcagaaccctatggcagatgtgtggaagatgtatttgaaagggctaagactggaggcaggaagataaattaagaaaaaacaatagtgaaattttgcaccttagcaatgagagaaatggagagaaagggtcagatttgagaaatatttaggaaataaaactggcaggacttggtgatgaactcattagagaatgagtaaagaaagagggtgtaatagttgcgtagatatctgagcctatttgggcttctataacaaaataccagagactgggtaggttataaacaacagaaatgtatttttcactatactggaagctgagtaggtgaagataaaggtgttagccgacttggtgtctggtgaggatcgacttcctagttcatagatggtatcttctcactgtgcccttacgtgatggaagggggtgagctaactctctttttattagggtactaatcccattcatgagggctctgccctcatgacttagtcatctcccaaagtctccacctcctaataccatccccttgggggttaggattttaacatacgcattctgagtacacagaaacattcaggctgtagcactaagactgcaatatcaaagtaccacaaattgggtggcttagaacaagagaaatttattgtctcacagttctagagtctagaaatatgcagtcaaattgttttcagggccatgctccctctaagactctgggtagaagccttctttgtcttctggtggtaagagttgttccttgacttcccctgacttgtggctgcatcactccagtctctgcctctgtagtctcatggtgttttccctgtgtgtctctgtcttcatataaagataccagtcatattggattggggcccaccctactccagtattgcttcatcataaatgatcatatctgcaatgactttattttcaaataaggtcacattctgaggtacttggggttacaacttcaacttatctttttaggagacacaattcaacccataacagacaataaagtcaaaactgtgcttagtttactacctaagggtctataggatattgccactggtgagataggaaacacaggtataagagctagaagatgaattcgattttctaaaggacatacaggaagagctgttttaggaatcagttctacaggtttgaagtgcatctctttaagatagaaacaagctgttatgacttacgggtagcatcagtaattggcttcatgttttcatcgttgagaacatgagatgaaggttcacaaaagagttttatagcaactgttattctggcagcgctggtgatctctattttgagctgttatcctatcattctcagtaattttagaaccatcagtcgggaagtgttctttatcaaaactgagtcattttaataccaacccacaaaaataaaaactaaaaaaatttaaaaaaacatcgaatcattgtaataaacacctaaaccaccaacacaatagcttgaaaaagttgtcaaattttcttaagactaatatgggtaaatattgttttaatataaaaaataatagatgttagacattcagacatcctcaatttggaacaaacaatatattccctttttaaaaatattctttctcgatgtgttaacgtttacaactatagttaacatcttcattatgtgaataaacaaaataatcatagtttactattgttaacatcaattttatatttttaagaatgtttttaactttaaatattttaaatatttgatttagaaaatatcgtcacacaagtatgttccttttgtgcatctcattgaatttagtaccatctgtttgttttctaccaacttgaaatgcttcaaaatttatttgtccaaaactctaaaactatttttaattcctaattggatttttctcttaatgcaggaggtcttgctggagttgctagaacaatgtgtggatggcttatggaaggcagaacgttatgaaataatttctgagatttccaagttgatcgttccaatttatgagaaacgtcgtgagtttgaggtaggcaatttgaacatttttatcattgacttatgtattttattttggttttagggaaaacagtaatatagttctgtcactattattcgacttgtgtcctctgaagaatataaggttcattacattatgacttttgcattttatcatagagtatagtctatcattttgacacatttgtccaatttcaaagtgacaattcctaaaaatgctattaaatcctgagattttttaatgatttcaccacaaaggaatgataaatgtttgagatgatacatttactaattaccctgttttgatcattacacaatgttggcatgtatggaaacaacatttcccccataaattgtaccccataaatatgtacagttattatgtgtcaattaaagacaacataaaacttcctctggtcctgcttatgaaaataaagtaaaacttaaaacatcctaccttatattcatttatgttttccaaatgaaattaagggtaaaagatccaaaatagaaattgagatttaaattagaccagtggttctgaaaaaaaaaatttttttttgagatggagtctcgctctgttgcccaggctggagtgcagtggcgcaatcttggctcactgcaacctctgtctcccgagttcaagcagttctcctgcctcagccttcccagtagctgggattacaggcatgcaccaccacgccccgctatctttgtattattagtagagacggggtttcaccatgttgaccaggcttgtctcgaactcttgacctcaagtgatcctccggccttagcttctcaaagtgttgggattataggcgtgagccactgtgaccggcctgaaaatatttttatctagcaacctcccctcttcctctcagagcgtaaaataatcagtgttgttttcactaaaccttcacttcaaaaagctgtcaaatttccatgttacccagggaagaggcatagacatgattctattctttataatttagcggagaacctaaaggtgctggcaaatgacagtggggtaggtaataatacactagtaatacccctattatgagaattttaaaattttgacttgccagataaactattgataaagtttagttaataaagaatagtagtataatgcacagcaattgccaccagcactaaacaggattttttaaatattcaagtctcttagtccatatcataatttctgttgctactatgctgggaagggatgatttaggattcaagccattttaaaaaagcaaggcaatttattctttttttttgttttttattttatttatttagtttttttgagacggagtcttgctctttggcccaggccggactgcagtggcgctatctcggctcactgcaagctccacctcccgggttcacgccattctcctgcttcagcctcctgagtagctgggattacaggcgcccgccaccgcgcccgactaatatttttttgtatttttagtagaggcagggtttcacc[139 bp omitted]ttgacgtggtttctgagagtgaacacacatagatttaatataatctgagtagtgttttcatctctcctccaaactagctctgatcaaattcactttttcttcccagattctaggtcttcctctctctgccatacttttggtgtatatggggcatgcctgaaaactcatagtagaattcaagtgaatatattaataagctgaagtataggtcatacagatggcaaagaatagcctatgagacaaaaccagatttgccattacccctcctatcaaagcattacatctgaagaacctttgtagtaatttcaaaataaagtccccattttttgactcttaggatgaaggaagttctggctgttagaaacccagggagccttttgctacttagccaaccaacagggaagaaagaaaaatatatcttctttatacattaaaggaaatgatgttttctacaggggaactactcctatttccttggaggggtgtaagggtctgtataaatcccctagaactctgtatagatgaagtaattgtgtttaagactgatgtagctggagcatggtatacacgcctgtgattccggccacttgggagactgaggtaggaggattgcttaagtccaggagattgaggcttcagtgagctatgattgagacactgcactccagccttggctacagaacaagatccaatctcaaaacaaaaccaaaaagtagaacactgatgcatactttttcagtgtatctctatggaacgggctgaaaactatcagagatagcagccaaagtaaggaagatttccctccaattgagctcaattataaaagataatatgggaggaattttagagaaagaagcttgtgtgtttttccttttttgttgaggtgaaatttatataacatacaattaaccattttaaagtatagaaatcctattatcctatcattctcaatatgcacccaccacctctttctagttttaaaactttttcatctccccagaaaaacactccatacccattaagtaattactccccaccccactcccattttccaataaccactaacctgctttctggatttgcttattctggatatgtcatataaaaggaatacagattgagcctctctaatctgaaaattcgaaatcataaatgctcccaaatctgaaactgtttgagcatggtcatggtgctcagtggaaatgctcattggaacattttggatatcagattttcagattagacatgttcaattggtaagtccaatgcaaatatttcaaaatctcaaacacttctggtccaaagcatttcagataagggatactcagcctgtgatattatatgtgaccttttatgtctggcttctttcagttagcataatttttttttaattgagacagaatctcactctgtcatcgaggttggagtacaatggcatgatctcagctcaccgcaacctccgcctcctgggttcaagcaatcctcacacctcagcctcccaagtagctgggaggtgcacaccaccactcccggctaatttttgtatttttaatagagatggggtttcaccatgttgtc[142 bp omitted]acttcattcttttttatggctgagtaagattccattgtatggatatactgcagattgtttatccattcatccattgatggacatttgggttgtttcaccttttgtctattatgaatagtgctgttgtaaacattcatgtgcaagtttctgtgtggatatatattttcaattctcttgaatatatactagggagtagaattgctggatcatttggtaattctatgtttaactttttgaggacccacgaagctgttttccacagtggctgtaccgttttacatttcgatcatcagtgttctaggattcctattacttcatatccttaccaacattttttattttctgtttgttttattttgttttataaaatccatcctagtgcatgtgaagtggcacctcattgtcttggtttgcatttccttaatgacagtgagattgagtgtcttttcgtgtccttcttggctgcttgtacatctttggagcaatgtctattcaggtcatttgcccatttttaaaattggtttgcatatattttgttgttgagtggtaagaagtccttaaatattctgggtactaaacccttatcagatctgtgatttgcatatattttcttccattctgtagctcgtctttcacatttttgataatgttctttgcacaacgtgctctctttttctggaagtgcggaaaaacatatcctttggaaatatctgtgaacttgcataaaagcagtcctcactgcagcttacaccattgcttatttttatatttgcattttattttcctttttaaatacatggattgtttattctcatagctctctacctgagggctcaagcaaagcatttggctgccctttcagttaaaaatattccgatcctgtagaaaatagtagttgataatacagtatttcaaaatttaaaatttccattgagatgtgaatgaaatgaagcatgatattaagaaatacattgtcattgaggaacagaaaaccacataccgcgtgttctcactcaagtgggagctgaacaatgagaacccatggacacagagaggggaacaactcacacagggcttgttgtggggtggggggtgaggggagggaacttagaggatgggccaataggtgcagcaaaccacgatgacacacatctatctatgtaacaaacctgcatattctgcacatgtatccccccttttttttttagaagaaatttcttttaaaaagaaatacagtgttattttaccattttaagttctacccttagacctaaagttgttgaggactttgattgttacaaagggagatgagtatgaatggccccaccaagaccattttgaaaagaatatactggtgctttttatttttgtacattcatcttgaagacatttagtaattaaacaaaaaacaaagctgatttgtatatttttatttttcagaaacttactcaagtttatagaactcttcatggagcttacacaaaaattctggaagttatgcatacaaaaaagagacttttaggcactttcttcagagttgccttttatggccaagtaagtgtacttgaatccataaagttttcctttttaaacattcacctttgaattactagtttactatagcagctaggagtctatccagatagagtgcctattacaacagcagggagcctcttttgtatgtataaagttcactttggttctcatatctaaacccttcaggtcagaatacaacagaaaaggttttgatttctgtcagtttcattttctgttaagctttttaaagtacatattaaatatatagtagttaaaacttttaaataaaaaacaggtaagtgtacagggaaggaaaaaacctagtttggaaatcttcctcaggccatatgtttatgtgattataaatttgaaaattaccaggaatttaaaaattctcatgtatttgaaattaaaagggtaaatacaagcatgggacttttagtaatattattcaaaatttatttcaaatatattattactagttatttagtagattttctttaaatgttgtgtttgctcatattatttataagttattatttgtttaactttataatagtctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaacacataccctacatgttgaaatcattatttgttagttccaggcattgtacattgctcctgactttttccttttttaactggtagagaagcatgaaaacagagctttccagataataaaagaaagaacaggggctttggagtcagagataccaagcttcaaatctctactctctgccactcactagctgtgtgaccatggggaaggtacttaactctctgtgcttcatcgttcttagtaataaaatggagataataatagtagtattttcctcatgaggttgttgtatggattaaatgagttaatatatggaaagtataatcactttcctggtacataaaaagcattcactaataatagcaagctagcatgctcactaaaggttagatattattgtaaatgctattgtacatcatgattctccgttacatcatgattaaaatcaccttggggcacacattttattctaagatatccttagttcagtaatagtgactgtagttaacatttgcaatgaaataggtttaggagagatccttgagccttgctctaaaggttatccatcccactaggccctgccaaggcatagtgagaaggcttatattatagcaagagaggccctttcctaggaaatgcatagttccctatagacaggatttgggggaagcactgtaggaatgcctgactgtccttagttgccttgggtgtgcccagacttagagctgatttttaagggtaggaagctcatataaagttcaagatttgtatccacagtgatatttactgagtgactatgatatgcgcagtgctatgcagaacacttaaaagctagcaggaagcattaccagagtgaaaaagcccatggctattgtaaagacacttcattgtctaccacgaaaataatctcttcactttgtatacttacatatatctcttggagatgactttatcttaaacacatgcctaagacatttaaaaatagatttggtggtagtttcaacgtaatatatggcaaacactctctacttctttccttatcagtttcactattttgtgttgtttcgttgaattgagacaacagaagattttctccccttgcagccagatagtgtaagacttgttcccacaatattgattactgtataaatggaaaggtaatgaaaagtcagactttctgtgcaacatgcagttttctaccttattctgcctctgaaaactgggccaaagaatgctagcgacaaaccactacaggtggctggactcctgatgtttgttatgtatcatattttagtagttccccacaggcaacagacataataagcagttctggcttttaaaatatatttattgttttctcagtttgtgaaaataaaaattaaaaatattcttttcccttgccaaagaacaaaatctgcttaagggcaaaggcaatttgaagaggagtttggcaatatcttccaatattttaaatgtatgtgtccttggacccaacaatttcacatttaacattttatcttgtagatgtacacatataaatgtatatgtttaaagttgttcactgccacaaaatttatatagcaaaaacctggaagcagtctaaatgtccatatggttaaagaaatggcggtattacccatataatggatataaccacctagacattaaaaagcatgagagatttgtaagtgtccatatgaatctatcaagatgtatatttttttcttttctttttattttattttatttttttttagacagagtcttgctctgtcacccaggctggagtgcattggtgccatcttggcttactgcaacctccgcctcctgggtttaagcaattctcccacctcagcctccctaatagctgggattacagtcgctcaccaccacacctggctaatttttgtatttttagtagagctggggttccaccatgttggccaggatggtctcgaactcctaacctcaagtgatccacccacctcagcctcccaaagtgctgggattacaggcctgagccaccacgcctggccgcttttaatttttttcgagacagggtctggctctgtcgcccaggctggagtgctgtggcacgatcacagctcacggcagccttgacctcctgtgctcaagcgatcctcccacctcagcctcttgagtagctgggactacaggtgtgcaccaccacacctggcttatttttgtttcttgtggggtttttgtgtgtgtgtgtgtggagacggggtctcactatgttgcccaggctggtctcaaactcctgggttcaagcaatcctcctgtcttagcctcctgaataggtgggactacaggtgtgttaccaccataccccagctaatttttttatgtttcttagagacagggtcttgctatgttgcccaagctggtctcaatctcctgcgctcaagcaatcctcctgtcttggcctcccaagccctcagattacaggcatgaaccactgcaactggccccatgtaaatcttttaactaagcaatttcttttctaggaatttatcctaaggaaaaaatcagaaaaaaaatgcacacagttttaaatacaaggatgttcatcagaacattatttacaacagcaaaaagttggaaaacagcctgtctccactaatgagagaatggtccaataagtcatgtttatccatacagccattaaaagtaatgtcagtgactatagtataaactattggccagacatggtggctcatgcctataatcccaacactagggggctgaggcaggaggatcacttgtgcccaggagttccaagctagcctcagcaacacagggagacctcatttctacaaaaaaatttaaaaattagccaggtatggtagtgcatgtctatggtcccagctacacgggaagctgaagtgggaggatcacttgagcccaggaggctgaggctgcagtgagacatgatcacaccactgcacttgagcctgggcaacagagcgagactccatctcaaaaataaataaataaactatgatacctgtgtttttattgaggtgtaattcacataatgcacaatcaaaactgtttagtctgacctcaattttctgaatacataggcatagaagaaagatgagaaggaaatatataaaaatgtgaataatgatcattgctgggtagtaggattacagtaatttttttttttttttttttttttttggagacagagtttcactttgtcgcccagactggagttcagtggcgcgatctcggctcactgcaacctccgcctcccaagctcaagtgattctcctgcctcagcctcctgagtagctgggactacaggctcatgccaccccgcctggctaatttttgtgtttttagtagagacaaggtttcaccatgttggccaggctggtctcaaacccctgacctcaagtgatccgcccgcctcggcctcttaaaatgctgggattacaggcatgagccaccgtgcctggccaattacagtaatttttaatttcttcgtatgtttctgtagtctccaaatagatttctgtaacttctttataatcagaagtaagtgatttttaaaaagaagaatgaagacgccctttattggaaacacaattataatggcaatgttcctcacttggtctcaaagaagttagtaggttaccttatctccttttcccttccactgaataaaataaaaaataaaataaaataaataaataaaaactttcttattttataggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaagtaagtacaattttacatattaacttcttatttgtcttggtctttttcagcatacacgagtagcagctggccagctggaacatacaactgaaattttaattattatttgttctgctgttcagttacaagtttgcacaagcacgtccatgtgataaaccatcattttcccatatgtcatccatgattgcccagaggtgtctcataaagagaatttctctctgaatcctgaagtactatatgggaccctaagtcatcttctagataaaggatggggagagttaagcacaatagagttttttctttaatttggctgtttgaacaaatgattttctaaagtcagtaaatcaatcttaacattttaatagcttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtacgttggtcatccaacatgtattgaatgtttcttgatgtttcttttggttttataagggcacagagcaagcattaattgtaattatgtgttgggcacttactgagtgcaaaaacctgtgcattattttttgttcatttaatgaagatattacattgaattttttaaagttttgtgttatgtcagaggactttaacataagtccgatgactgtagcgaagccctgtatgtacatatcagaaatcactaacttactagaatatcatctttgtagattattttctttagttaatggttttttgaaataaacttgaaataagcatatatttctcagatatggatttcttgtatattttgggatttttaataaaaaagagaaatgccaaaacttcttttgattattgcattctggaaacactctcatttttcttctattgtgatataggtcaatgctggtccattagcatatgcaagagctttcttaaatgacagccaagctagcaagtatccacctaagaaagtgagtgagttgaaagacatgtttaggtaagtgttttatagttttcaggttagacccgtgttcgttttctctattttcttcttttaaaaaacaacaaagtattgaccaaataatacccttccaaaaagggacattctctgtggtcttttacaatatctaagtgacctcctaatggcactttgagcaaatgtgagatcagtttcatcctgcaggacattaacaataccctagtgacccaagagattaaatatgccagtttactatattgctttgaatattttaagtgacacaaacacaagcctatgttccttatgtgctttccttcttcacccaattgacctcctgttacagcatttcagaccatttggggtaggaatagaagtggggcaggaaagattgcataggctcactccagtcccctgtccttacttctacttggactctgccaaactagggcatgcaacatcttgtcttcagtgagcggctctgtaagcttaggcatgtatgaatgctcctacattagagaaatatctttaatatataaaagtcttcattcagaagaagagaaacagttgagtaatatggactaaggagaaagatgataatctatccactcatttgctcccgacttattttgtttacttttcctgtctatgttttatcagctgttccagagtgcagagtaaccagtagtcattcattcaccagtattaatgcctggtacatgcaaaagactatttgttgctatgacagggatataaaacaaatggacaatgaagtactttgtcccctaagacctacactctaattgtggacattaaacataaacacatgaaataatggaaaaagacttttatgataggtcatcaactttctgttctccttcctagcagcccagggaagatccttcatacctgtaccacccagcactgtactagccacatagtaagctcaaaataaattctttttgaatgaatgactcgttatttataggtgcaaattaatgtcagcacaactttagctgatagaatgccaaggaaatgattgagcaagtaggctttccagagggtatgtgttttgagccaagtcttgaaggagataagaaatgaaaccataaggcaaaggtggaaaggaaagaaggcatttcagacttaggaagagacattaagaaataaatgcacagtgagaaaatagaggattctgatcttcttcctaggcaagccatggctaaactgagttatcaaatggattgtcagtgatacttcctaagaataaataacaagacctttatctttgatattcatccacaggaaatttatacaagcatgcagcattgcacttgaactaaatgagcggctaattaaagaagatcaagttgagtaccatgaagggctaaagtcaaatttcagagacatggtaaaagaattatctgacattatccatgagcaggcaagtattagggtgactaaaactgaaaacatgatctgcgggtcccaaaattgttgcttagcaaaatataatggttcaaaatgcacaaccttaaagttattaagtctatattttaaacttttttcatattatctttaatcatttaagtgatacaatacaaatcaaatttgcaacaattatctaaagtggttagtgatgcagttatctgtaagaaaccattttgttttttgtgctccagtgtcagaggcaagaggttgaactgaggtataccgttatcaaatagattacatagtttgtttttagaaactatctagttgatgagtttctattcctcataatgcatagaaaaagcagcaaaaattcctccttcacaaaagatatgacaattgcacatgctattttaagtgagtatctactatattacagttatttcatttgcatgcagctgcatgacctagtgttgaactctaaattattcaaattgaaaacaaattattcaatgtactgttattactgtaatcaagatattctgagtggtcattttataaaattttgttttccttttgaagcatggatttttcaaatctactgtcgtatttcccacttgtctgtatcagttattcccataaaacatggctatttctcttagatatagagaccaataatttagactcttaatattgtatattgatagctaaccaagaaaactcttagtttctattggcttatatttatgcaagccatcctgtcattatgaaacatatttgggtgtgccttacttttggcaaatgttgactttgtagtgaattgagtttcacataaaagagagccaccttgtagtcatacactttgaggcatatattaatactgagaagtaagacaagtgttaatgtgtactgaaatttgaaatattctcttgagctccataaatgattacttgacaaaaagacatgactggatattccttgtcccctttcagtgtaatctgttacagaataccgaagtatatagtcctttcaaaaacttcttcaagcttttttttcttttttttttcttttttttttttttttttgagagggagtctcactctgtcgcccaggctggagtgcagtggcacaatgtcagctcactgcaacctccgcctcccggattcaagtgatttctcctgcctcagcctcccaagtagctgggactacaggcacgtgccaccacgcctggctaatttttttgtatttttagtagagatggggatttcaccatgttagccaggatggtgtcgatctcctgacctcgtaatccacccgcctcggcctccaaaagtggtgggattacaggcgtgagccaccacgcctggctgcttttgatttttaaaaggatttatattatcataaagctataaattacagatttctcagatagagttgggggtggtcattgtagcatctgttgggtatgttttgtaatttcttagcaataagtaccctccttgcctgtcacatctgaccagcatagataatcagttattcatctcttaacattctagtatgctttcagattagtgtcatgagttaatatttttgtaagaggaaatttctctattataaattttatttaagccttatgatttgtagcaacacaaatgatatgtctcaatactgccactatagatcaatctgtgggcttaatactgaagtttcacaactaacttgagaaccaagtattgaaagcttgggacctaagttaggactttatggtaaagagagtggatataatgtatatagcgttttttacctcaatctactttaagcacaagatttctgttgctttttctttagattacacaaaatggatcatttaaaaaatatttaaactaatacgaatatctatgtttatatacttactggaatacaatctttaaattttatatttatgaagttcttcctttccaagaaaaatcttctgtatcaattagcttatacaattataatgtgtctttagaaatatgcacttaagacttttatcttcatttactattattttcaagtctccagggaaggaacataggtatctgcatgtttcaaaagtcccatagatgattctgagaaccactgtgttagatcattcataaactcatgtcagagtctaccatttagagctcttgttatgaccatctgttaaaaaatattttaaagattgtgttacctctcgctttttattgaattttgcattttacagtctttgtttttcttaatgagtaactagatcttttctgcttttttgatatgctgcctttgtaatacagctttgaagacttaagtcggtaatgttattctttgctctctctgctttctgtctttttaaataactgtcagtgataaattgaaatatgcctgcaatttcatatacacattctttttttggcagtggctattttgcttcatgataatcatgctgatttcttctgttttagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaattagaagtgaaagaaataatactttgaacttagcatttttcttgacaagaagctcaattcattatcatactaatccttggtaggaggagaagaaaattgataacatttccgtaatacacggatatttaaaattggggagatcatttgaatccttgccaattagtagtcaaggctgggctaaaggaaccaaaagcattatttcacagaaaatttcaaaaggaaaggatatatttacaaatatacgaagcttaggctggacacggtggctcatgcctgtaatcccaacactttgggaggctgaggcaggcggatcatgaggtcaggagttcaagaccagcctgaccaacatggtgaaaccccatctctactaaaaatacaaaaattagctggtcatggtggtgcatgcctgtaatcccagctactgaggaggttgaggcaggagaatcgcttgaacccaggaggtggaggttgcagtgagctgagatcacgccactgcactccagtctgggcgacagtgagactctgtatatataacatatatataatagtaagcttgagataccatatatatatgttatgatctgatgacgctaggtaatctagtaggtctcccttctacatacaagacatctaagggatttatacagggcaagcagcatttgttgccaaagctttatcatctggggccatctacaaagataaaacatttctgagattgcagtcagtacatcccacagaacttcaaagcttttacagcaatctgaggtaggagttttgtaatgattattttcttcagttacaagattaataaacattttgattagaacttaatggttgcagcatgtcttgggtcaatgtagaaaaccaccacagatttggcaaactagcttgggattatatttctgtctatgaagaaatctcagattgcctaaataattcaggagaaaccaagatgtgaatgacattttttagcttgaattatccaaatcattttggctgccttctatgggaactcgggttctagacttccttttttttttttttttgagatggagtctcgttctgtcgcccaggctggcgtacaatggcgcgatcttggctcactgcaacctctgcctccctggttcacgccattctcctgcctcagcctcccgagtagttgagactacaggcgcctgccaccacgcccggctaattttttgtattttttttttagtagagacggggtttcactgtgttagccaggatggtctcgatctcctgacatcgtgatctgccaaaagtgctgggattacaggcatgagccactttgcccagcctacacttattttccttatgtggtttagcctcttttacagatgaaaaaacagtcactaaaatataaatggattgcacggggccttggctttttgagcactttgtgatcaagtaaatcctagagattatgctcctggcctgaccatttttatttttattttttggggggtaccattttttcttttttgagacaaagtcttgctctgtcacccaggctggagtgcagtggcgccatcttggctcactgcaacctccatctcccgggttcaaatgattctcctgcctc[134 bp omitted]gcctcccaaagtactgggattacaggcgtgagccaccgcgtccagcccattttttctttatatgtcatttttaagctttcaggagagcatgaacttatttattaaaagttaattttgtattttaataggggacttttacaagtatttccaaggcagtttgtaattccttaatatcttagagtaacctgtagagttagtttcacctttaaagtgattatatttgatatgtatgtgtgaggaatcatcacctctagtaaatgctgcattctgagagtttggcatcttgaggagactccagcactcttctgtctgtaactagtccctgtcaaagcccctagcacagcaatatgcactgtgggtagattttttaatgtaataaatggcccctattgccaaggatctcgcagtctagttgagaaagcaagacgcacaaaattaaatagtacaagaattaacaatgtaagacaggagaagtcatatgtgagtattgccaaatgaacgacagcattcataactcaaatcacattcaaagaaagagatcactgtgaattgtaaatgttcagggagggtttagtgaagaaaagttaagctttgaacaggcttccaaaaatggagaggggtattctaggcaggaggaacaccataagcaaaggtgcaaaaagaatttgtggaggttcaggggatagtaaggagaccagttttgtccaagaggtggtagatgataaatctagaaaatacaggctgggcgtggtggctcatgcctgtaatcccagcactttgggaggctgagacaggcagatcacttgagcccaggagttcaagaccagcttggccaacatggtaaaacactgtctctaataaaaatacaaaaaaaagttagccaggcatggtggtacacacctgtaatcccagctacttgggaggctgaggcacaagaatcgcttgaacccgggaggtggaggttgtagtgagcctagatcatgccattgcactccagcctgggtggcagagtgagattctgtcaacaacaacaacaacaacaacaacaaaaagaaagaaaaaagaaataaaatacattcggactgagattttggaaggcgctgaataccaggctaatggtatttggagtttactcaataggcatgagagagctagccaaggtttttaaacagattacttaattaaatgttatttttagaaatttaatcttttatattgctgccagatgtatttgaggtagagagacatggaaattaggaaaccagttacatagatattgcaataaactaaattcaataaacctctagatgtgagtgatatgacaagaatggagaagaaaggacgagtcccagagacatatatggaaggactaggtaagactcattggatggccaagggaaaaaaaaaaagaaatgtgaaagataattttgtgtcctgtggccagggagtttgccatgtcatggcacaagctcactagatttatttttccaactctcagactaaaggtagcaagctgtagagaacaaggtgggctcgaacagagaaagctaggtaaatctgttttttaaacactacatgtattaggcattaaagtgtatatagtttaatgatttcttgaagtgatttgtcctctacaaattaattaacaccaaagaatacatttctcctatactgattgttttgcagttaagcttgagtccaatttcccctagaagttgttgttttgatagtctttggacatactgtgaaatgtgattaagtcacccttggtagtgttagtttatcactacggtgaaaaaccatagagaaaataagaaattccatggaaattttcctagtaaccagttgtcaccactggcatcatgtatatagatgggattgttattgttaccgtatttatatgatttggctgcctatcaaaatattatatattttcaaaagtgaaacagaaagcagcagtggtagtaatgtccttggaaccttgaccaacaacacatcatcctagaactagagatgactctaattaagaaactagataagtcatgataataagaacgcacatttttaaaaaactatttcgtatctttttttcttctaacttttaggttcagggggtacatgtgcaggtttgttccatgagatattagctttctctgagatgaagaacctgagtgatataatggattaataggaatttccaaactcttcaaaacattgataattagacatatgtcttgggcttctgatctccaaaatgttgggctacctttagtctcagtcttgttctaacagtacactagttcagctatcaaaagacaaggagaggaaaggagtaaaagttggttgtgggtggggagtgggtttgtgtaacaaggctatacccctgtcttgggagttggtgagtaagagtgctttatttatcttttttttttttttctaagcacttaatggtcactgtctaaaaacagtgtatctatgtttgttcatctcctaatgggagtcgtggctaagttctaagattttgcctctgtgcatagcattttaaaacttttccaatgttctttttttttgctttgtttttcctttttattgagatataattcacataccatacaatttacccatttaaagtacacaattcagtgttttttaaaattacatccacagagttgtgcaagtatcactacaatttaaaacatgtttatcacctgaaagagaccccatactcattagcagtcactcctaccggtcatcatcctccagcccctggcaaccactaatctactttttgtccctacaaggtttacctgttctggacatttcatataaatgcagtcatacaatatgtggccttttgtgtccagcttctttgacatagcatatttccaaagttcatcgatgttgtagaatgtatcagtacttcattcctttttatggctaaataataatccattatatagatacaccatattttatcttctcatcagttgatggacatttgggttatttccactttttggctactgtgaataatgttgctgtgaacactcacaagtttttgtgtggacatgtttttagttctcttgggcatgtacacagaagtggaatgactggttcatatggtaactccatgtttaaccttttgaagaattgccagactgatttccacggcagctgcaccactttatattaccaccagcaatgtatgagggtcccagtttctcaatattcttgacaacacttgttattatctgcctctttgattattgccatcctagcaagtgtgtagtatctctttgtggttttcatttgaatttccctgatgtctaatgatgttgagaattctttcatgtggttactggccatttttgtatcttcctcagagaaatatctcttttaagtccttagaccatttgcttttttgagacagggtcttgctgtgttgcccaggctggagtgcagtggtgcgatctcagctcactgcaaccttcccatcccgggctcaagcgatcctcccttttcagcttcccaagtagctgggactacagatgaacaccaccacacctggctaatttctgtagaattggggtttcgccatgtttcccaggctggtcccgaattcctggcctcaagcaatccacccaccttggcctcccaaagtgctgggattacaggtataagtcaccgttcccagccccttagcccatttttaaatcaggttgctttactattattactattattgttgagttgcagggttctttattcgagatgcaagtatatgatttaaacatatttctcctgttctgtgtgttgccttttcactttcatgatggtgttctttgaagcattcaagtttttaaaaattttgatgcagtccaatttatattttcttttgttgcctgtgctttggcattgtatctaagaagaccttgcgtaatccaatttcacagaaatttacacctatgttttctcttaagagttttataatcttaactcttacttttggtctttggtccattttgagctaattttgtatatggtgtgttgtagggattcagattcattcttttgcatgtggataaccagttttccctgcaccatttgttgaaaagaatctttcccccatccaattgccttggcacccttataaaaaatcaattgaccaaaaatatgtgggtttattctggactcttagttctattctattgacctctgtatctgtccttacgctagtgccacaaagtcttaattactatagctttgtagtaagattttgaaatttggaagtgtgagtcctccaactttattctttttcaaaattgttttgtatattctaggcccctcgcatttccatttttattttattttatcttatttttttgagacggagtctcactctgtcctccaggctggagtatagttgcacgatctcgggtcactgcaacctccacctcttgggttcaagtgattctcctgcctcagcctcctgagtagctgggattacaggaacatgccaccatgcctggttaatttttgtatttttggtagtggtgggatttcaccatgttggccaggctggtctcgaactcttgacctcaagtgatccaccctcctcggcctctcaaagtactaggattacaggcatgagccacacgcccaggcccatattaattttagcatcagctag[141 bp omitted]aaacctcgtctctactaaaaatacaaaaaaaattagccgggcgtggtggcaggtgcctgtagtcccagctactcgggagactgaggcaggaaaatggcgtgaaggtgggaggcggagtttacagtgagccgagattgcaccactgtactccagcctgggcaacaaagcaagactccatctcaaaaaaaaaaaaaaaaaaaaaaatggccgctgggattttggcaggatttgctgtgaatctgtaattcaatgtgcagagtattgccatctcaataataataagtgttccagcccccatgaaataggatgtttttctatttatttagatcatctttaatttctttcaacaatgttttacagttttcagtatataagtcttacacttcttttgtttattccttatgcccacaaggaagtttattccttagtattttatcctttttaatgctattgtaaatggatttgttttcttttcttttctatttatttatttatttatttatttagtgagatggagtttcgctgctgtggcccaagctggagtgcaatggcgcgatcttagctcactgcaacctctgcctcccgggttcaagcgattctcctgcctcagcctcccaagtagctgggattacaggcccatggcaccacacctggctaatttttttgtatttttagtagaaacggggtttcaccatgttagccaggctggtctcaaactcctgacctcacgtgatccagctgcctcagcctcccaaagtgctgggattacaggcatgagccactgcgcccggcctgatttgttttcttaattttatttttggattgttcattgctagtttatagaaatacaaatggtctttgtatattgatctgatatcccaaaatcttgctgaatttctgtattagctttaatcgtgtttttggtggcttctttaggtttttctatacataagatcatatcatctgcagatatagttttacttctttttaaatcttgatgtcttttattttattttgttacctagaacctagctagaacttcctgtataatattgagtagcagaattgcagatagccttgtcttgttcctgatctttgggagaaagctttcagtctttcacctttcagtatggtgttacctgtgggttttttatggatgctttttatctggttcaggaagtttcctccaacatgttttgcatctattttctgatccaattctccttatatatgtcatataggaatcaattcttcatgtgatcctgtatcacatataaggaaatggatgcataaatggttaagaaatgcactcaagacacgcaggaaattagagatgaggtcacggtatcctgatttatagtctattgttttcaactctactttttcctttggtcttctgcttcaacttcttgcaactttctagagactaaaaagggttcatcttttccactttttcatttaaaaggtaacctccatatgggtagagtctggatctgaacttttccacctctgttttcccagaacctagcacaggataagtgcttgagcagtctcaaggaaataaagccagtttagataaacagcacccctggagcctttattatgtgcaaggtattgtgggcagatatcccagaactcggagagactgtggttgagggagataacaaatagtcacattaaaaagatattatgggccgggcatggtggctcatgcctataatcccagcactttgggaggccgaggcaggtagatcacctaaggtcaggagtttgagaccaacctggccaacatggtgaaaccccatctctactaaaaatacaaaaagttagccaagcctggtggcacgcctgtaattccagctactggggtggggggtgcgggggtgggggagggctgagacaggtgaatcgcttgaacctgggaggcggaggttgcagtaagccgagatcgcacaactgcactccaccctgggcaacagagcaagactcggtctcaaagtattatgaagaagtctgataatagcaaatcagtggtagttacaagtgcttgaaaaggcagagtctttatagatgtagactgaaaaaggcttcatggaggaaatgccatgaatttttctcatttttattagaactgccactagcgtgtctgtgttgaggaagtactttaggccaagtttttaacaggaagtttaaaaaattaacttctttatttttatcattatatgaattccaacaattaaaaccatccgtagtacacaatatgcaaagcaaaaataataaagtgcatataaaatcaggtaacattctttatatgttttttctcagactctctcatcctgttttggtcttagacacaagccaagttaaatcagctttttctttttgtccagaaaacttatgctcaattttcttcatcctcttgatagaaaacctttacagccaacctcagtcaatttctgatcgacaagtctcattctttatataccatagtgttttgtaatagtcattactttagtagatctcctagaattgagtcttacaggctctagacttctcatcctgcatgcttactgcatgtgcctttcatagaaaatcagtgaaaactatcatatgagcaggtaaaggctgcagtgtggaagctgtagaccattcattcatccatcacacatttattgaccacccactgtgaaccaggtatatgaatgatcaaggcaatatttcacaggcagataatgcagatgggatgttataatctaaaagataattcaaaagtagtcttcttctgtcaataacgaatcttccaaattctgtattcttgaagagagacatcttatgtctctgatgaatgtgagtaatagttcctagtactgatatattgtaacaattaatatgttgattgagaagcaaaagctaagccattatagatgtggaattatgttcaatgcaaagctgaccagctcctatagtactcatgcagtgggttatttcagaattcttctgtggcatagtcaggatttgagataccttcagagccacgatgatatcatgtaatagtactatgtcctccctccccatcccaaactaaatctagacacaaatacacatgcaatgaaagaggattagagagaaagaaaggtggagttgacaaaattatccctatcagaacaaggaaaatgaaaatgaagccgggcatggtggcttactcctgtaattccggcactggggaggtcaaggtgggaggatcacatgagcccaggagtttgagaccaacctgggcaacatggcgaaaccacctctctactaaaaatacaaaaaatcagccaggtgtggaggcatgcacctgtagtcccagctactcaggaggctgaagtgggaaggaaacttgagcctgggaggcagaggttgcagtgagccaagattatgccactgcactccagcctgggtgacagagtaagaccctgtctaaaaaaagaataataatcataaagaaaatgaaagacttccagaagaaagcattgctgcagtttgttccacagcaactcccaagtagtcacagagccagctgaatacagttcaggtcacatgtaagagaatttttaaaaatgtacccacattatttgtacaaacttgtagggtacatgtgaaattttgttacatgtatgtaatgcatagtgatcaagtcagggtgtttaaggtgtccatctcccaagtacatttttgttttaactgtagtcaccctattctgctatcaaacattgaatttattccgtctatctaactgtaccctttaacccacttctcttcatcctcctttctgaagagaaattttcatggaaatgattttggatatttacacagaatgttttattttttaaaacaaagtaacctctctaaccaccaccacctcttctttgttgtagaaacaaaactcagaattgaagttttagccctggaatatcttcaggaggggaaattccagctctccccattggtttaaccatcttgtgatttttctcatttttattagaactgccactaccgtgatggcctccaagtttatttcattatagctctgtgacgctagatgagactgttgggttggggggatgctgccgggggaggggggtagttaggggtacccatacctacctgggtgttttggctgctctccctctaatgattattctcatcttgagagttttggcatccctactgtacagcacatttgttaagtatacaaattctgaagcaggttgactgggtcagaatcccagttttgtcatttaccaagctgtgggaccttggtcacattacttaacccctctaggtcttcatttcctcacctgtaaaatgcaggtatgaattgtccctacctcctaacatcgtgaggattcaatgaagccaagtatataaagcatagagaatgatgcctggactgggcatggtggtgtgtgcctttaaccctagcactctggaaggctgaggtggaaggatcactcctggaagagcccaggagtttgaggctgcagtgagctatcgtgccactgcacttcagcctgggtgacaaaagcgagactctgtcactaaaaatataaaaataatttttttaaaaaaggaatgctgcctggcacatctacgtaattgttacatctatatatgtgttatttataactgtaatctttcccccacagcataggataattttaccagccatgataccctctgtgtctctgggcccatccctccatccaggtaggggtaatggatgggtcaaggtcaggcaatttttgccatttgatatcttacaggtcacctctggcctccgttgatctcaccatatggtgaagatctgttcccccatgaagggacattgttttctgtgtggtggtataagtaccaacaaatatacacagatgctggctgttagcaactagtactgccatactggcgcatcttggctgaatatcagccctgctcctgtgtctgtctttttttttcttttcttttctttctttcttttttttttttttttttttttttttttttgagatggagtctcgctctgtcggccaggctggagtgcagtggtgcgatctcggttcactgcaacctccgccttctgggttcaagtgattctcgtgcctcagcctcccaaatagctgggactacaggtgcacgccaccacgcccagctaatttttgtaattttagtagaaatggggtttcaccatg[136 bp omitted]tatggctttcttgtgcatctgaggattgatgaaaattcccatgtgccacctaactataggatttctctgcttactggcacttcctttggctttgttacactaccagaactacacagaaagtggttttggatttgaaattcaactagtgggacttgctcagtattccctccatagagagcctctcatacacagtctcctacagttaagtttaatttattcccctcatttggatttccctgtcactggtcacagattgctattttatggctctcaagtagatcagaaaggttttcagagttccccttccccacctcctacccacttctctgtaacgacagacaccctttaagggaaacttggcccaaccaatattatttgaagacatttcattctcacttaggtaatggggcttggagttgaggtctacctttttgttgctttctagtaaagcactgacccctatctcacagtactctcctaagccctgtcctccctgacaacttagttgctttatctttccaggagcaccctcacattcctatattgtgcacactcaagacaatttcccagtgtccacttcctggctgaatcaatttccacaaccatgacgtgtaactccagctcatctcaccaaagggcattttagcaagtcactgcagatgctgcaactcggaaaaacacgtttagttaggatctgatgagtcttctccattagataaatgttgtgaggtggaacttactgtaatttccttctctccacccaagatctaaaatttttctctgagttggctccctctctaccttcagtctcccttcctggaagatttaccccagcaaggatgtcttctttcagatggatatgagtaagttagtttctgccctcgttctgtttcttccttctcctgctctgatgttggcacatccttaggaagtcagctactccaccccctctaccaagatgtggcccaatgagggtagggtatctttcacttcccctttctgggaggccgactggccaagactgaactacctagacccccccacccttaccactgtcattctactcactgaccccacatgctcattttttggttgtttgctccactgtccctgagatcttagaggaggggttcttaactgggggtggttttaccccctagggaacatttagcaatgcctggagacatttttggttgtcacaactggggcaaagaggttgccactgacacctagtgggtagaggccagggatgctgttaaacatcctactatgcacagctagcctcctacaacaaaaactcacctggctcctgctatcaatagtgcagatgttgaaaaacactggctagaaggaatgcctgcctcactggaatgtgtgatgcctactccaccgctggtttgtcttcaaggagccttttgctggtcaactcaccaataaatccactaggagatctctcccattaatagctgtttgtaccctcatttacatctgtctgccccctcacatgtttgcatgccacaagtaatggtggtctgctcaaccttcattcctaactctgcacttcatctgcaggttggccatactcaagaacctgaaggtgctcaggatctgcttcatgatctccgtggctatccctttcactttccggtgaagtaaaggctttctcattactagaaaccatccaagttaactaggccatacaattacaatgtcattgctactaccacctatgaagcagtatagtttatttaataaaacaaaacctaagacctctaagttattagccctgaaggagaagcagtaagtcgggaggacttgtctactgaaggacaaaaacaaactcccaaatcaatggagagacatattttgttagaattataaatatgtgacttctctccttaatatctgtcaattcaatgccaccttagtcaaaatcccagaaggattattattattattattattattattattattattattattattattttgagatggagttttgctctcttgcccaggctggagtgcagtggcacgatcttggctcactgcaacctccgactcctggtttcaagcgattctcctgcctcagcctccccagtagctgggattataggtgcaacacgcccggctaatttttgtatttttagtagagacagtgtt[133 bp omitted]ttataaaatttatcagaagcacctgaagtcccagctactcaggaggccaaggtggaaggattgctggaggccaagagttcaagactatcctgggcaacatagcaagactctgtctcaaaaaaaggaaaattgaaataaaaaataaaatttatcagaaggaatcaagatgtaaaaacagctaagaaaataccaaagaagaggagtaaggagccctggcagacattaaaatgaataatgtagctaattaaaattgaacattttacccataaaaattaaacctaaaaataaattggacatttactaatagagaaataggcagaaggatgtaataggacacagaatctgtatgtatataaaaatgtgtatgataaacgttggatttctgccgggcgcagtggctcacacccgtaatcccagcactttgggaggccaaggtgggtggatcacctgaggtcaggagttcgaaaccagctaacatggggaaaccccatctctactaaaaatactaaaaattagctgggcatggtgacacaagcctgtaatctcagctactccggaggctgaggcaggagaatcgcttgaacccaggaggtggaggttgcagtgagccaagatcgtgccattgcactccagcctgggcaacaagaacaaaacttggtctcaaaaaaaaaaaaaaaaaaaaaagttgtatttcaagaaataacagtgtcaagatcattcaataaatggtgttggaataattaggtaagcatttgcaccttttttttttttttttgagacggagtctcgctctgttgcccaggctggagtgcagtggcacaatcttggctcactgcaacctccacctcctaagttcaagcgattctcctgcctcagcctcctcagtagctgggattacaggtgcgtgataccacacttggttaatttttgtattttttagtagagatggggtctcaccatgttggccaagctggtctggaactcccgacttcaaatgatccacccgccttcgcctcccaaagtgctgaggttacaggcatgagccattgcacccggccttatgcacaaaatttaagggctctctatttacacaaaaataaatttcaaattgattagagatttaaatgtaaaagacaagatcctttaaaaactaaaactgggcatagattattatatgtgcagtagaggtgaggaaagtctttctaaagaagacttaaaaaccagaagtcaaaaggaaaagcaattaatacatttgatcatataaaatttaaatttaaaaagattataggctgggcatggtggctcacacctgtagtcccagcactttgggaggctacggtgggaggatcatctgaggctagttcgagaccagtctggccaacatggtgaaacccagtctttactaaaaatacaaaaattagctggacacagtggcatgtgcctgtagtctcagctactcaggaggctgaggcaggagatt[135 bp omitted]atttgtagtatacatgataggataaggataaatattcttactataaaaagagctcttacaaatcaataagatgaaatttctcaataagaaaacgggtaggctgggtgcagtggctcacacccgtaatcccagcactttgggaggctgaggtgggtggatcacctgaggtcaggagttcgaaaccagctaacatggggaaaacccatctctactaaaaatactaaaaattagctgggcatggtagcacaagcctgtaatcccagctacttgggagactgaggcaggagaactgcttgaacccaggaggcggaggttgcaatgagctgagattatgccactgtactccagcctgggcaacagaaaaagactccttctcaaaaagagaaagaaaagaaaatgggtaaagaacgtgaataggcaatttgcagaagaaaaaattcaagtggtcaataaacataggaactaatgttcaattttattattaaataaatatgaattaatactagacaaaggaggaaatatcttttttaaactctaagaagaaacaaaatgataaacatctgagatatctagtctaaaaaaaggttggtacaacttcagagacactttatctgggttccttgctttttctctctgcttcttactccccataaacctacttctccccacaggaggtgccttctagacatcttgacatcgtggtgaagatggaaagagtgttttactagacatgccaagaaaggctctcccagttcaagtttgcttgtttggttgtttttttgttttgttttttgttcgtttgagagacagacctttttaccaaggtggctaacacaaagaattaacttgtccagctgagaactcacccctgagtcacagaggtttatgttactctggttaactcaaacatagaaccacaactaagcaaaccgcaacaactgcggcattcataaaacaagaatcatgcttaggcagtcatttaagtgggctcatcacaggacagtaaataatgacaaaagaaagcagggtgtggaagggaattgtgatgttaataactcgtacaatgcttaaatgcatgcccggcactgttctaaattaaatccttcaatgatcactacaactttgttaggtaatgacacatatccctcattttatgaatggggaaactaaggcacagcaaagctagataacttgtttgagatcacacaatcggtggcaatgctggaatttgaacccagagaatctggtgtaacagttcacactcaagccaccactttgagaggaatcaagggaaaaagaagagagatctaagagaataaaaaggggaggaaggaggaggaaaaactcagctcactaacacctgaaggcaattgctacatggtacccagcctcctttttcaggcccacacccaggtctttgcagtccccacctctacctctgttatcaagcttcctaaaatgacatgatttggggataagtgttcaaactatttttttcacaaataaatggtgtccagaggaattgatgttgtttcttttttctttttttttttttgaaatggagtctcgctctgtcacccagactggagtgcagtggcgtgatctccactcgctacaacctctgcctcccaggttcaagtgattctcctgcctcagcctcccaagtagctgggattacaggtgtgtgccaccacgcccagctaatttttgtatttttagtacagacagggctttgccatgttgaccaggctggtctcaaactcctgtcctcaagtgatccgcctgcctcggcctccaaagtgctgggattacaagcatgagccactgcgcctggcctgatattgcttctattgtatcttagattcagggggtacatgtgcttgtctgttacatgagtatattctgtactgggagtgggcttctagtatagccattacccaaatagtaaacattgtacctgataggtaattttctaactctctccccaatataataataataattattattattattatttttgagacggagtctcactctgttgcccaggctggagtgcaatggcataatctcggctcactgcaacctccgcctcctgggttcaagcgattctactgcctcagcctcccgagtagctgggattacaggcacccgccaccactcccggctaagttttgtatttttagtagagacagggtttcactatgttggctaggctggtcttgaactcctgacctcaagtgatctgcccgcctcagcctcccaaagtgttgggattacaggcatgagccaccgtgcccggccttattattttttatattacaaacaacaattgttttcagaaggaatccat[132 bp omitted]aaaccccatctatactaaaaatgcaaaaattagccaggcatggtggtgtgtgcctataatcccagctacttgggaggctgagggaggagaattgcttgaacccaggaggcggaggttgcagtgagccaagaccacgccactgcactccagcctggcagcagagcaagactccgtctcaaaaaaaaaagaaaaaaaaagctgcctttttggtttcagttttcttccctctgcctatgtgcaacctagagcaccaaaatcagaagatccattcatgccttttccgcagcactaagctataatttaaacaggaaaaggcaaagttgcagcttttgaacagccataagcccttacatcctagtaagatggcagactaaattgtagataactccagcttctcaaattcttaaaagccctgtagtcttcatccaccctgtgccatgtctttaggattctataagacagtaagactttatttctaaaccaactactgagattgaagataaaattagagctttaagccccttaccaaattaatgggaagagactctgaaaatttagaaattcacttctggagtagtggaagaatggcgaaattcacctactcagtttacagtggggcctctctccaagttcgagagcctgacacccagctgtttgctgagcttctctccttaggtgatccacaggcacctcacaatcaccatgctcctctttcctctcaacctgctcctcctcctctgttctccgtctcagttgaggacaccccttcctatccagtgacactggccagaaatttacaagtcacctagactagtggtcagtaagcttttcctataaaggactatttatagaaatatgtgaagctggcgacagagtgagactccgtctcagaaaaaaaaaaaaagaagaaatatgtgaagctttgcaagccatacactctctgctgcagctactcaactgctgctgcaggatgaaaacagctactgaacaatatgtaagaaatgggcagggctatattccagtcaaattgtgtgagtgctaaaatttggatgtcatgtcattttcatatgttacaagatattcttttgagttttttccaaccacttaaaaatgtaataaaccactcttagcttacaggttgtacaaaagtaggtgggctagatttggtatatgaagagcttgctgctctagaatcctcactctcctcccttccccacatctgatcagacaagtccaacaatctcactttgttttcttttttttttttttttatctgagaagggggccttactatgttgctcaggctggtctcaaactcctggtctcaagtgatcctcctgcctcagcctcctgaatagctgggactacaggtgtgcaccaccatgcctggagatctcactttttaaatggttattgaatctcttcatccatctttacatcattttagttcaggtacttgtccattttgctttttttttttaatttttgagacacagtctcgctctgtcacccaggctggagtgcagtggcacaacctcggctcactgcaacctctccacctcctgggttcaagcgattctcctgtctcagcctccagagtggttgggattgcaggcacgcaccaagcccagctaatttattatttttttttttttgtattttagtagagacgtggttttaccctgttggccagtctggtctcaaactcctgacctcaagtggtctgcccaccttggcctcccaaagtgctgggattacaggcatgagccaccgcgccaggcccattttgctttctgacatagacagttaagcaaaattgaaaactacaaggaaagatcctctacaactatcgtacatggaagtacatgtccttcccatgtttttttaagttccttatagtgtatagcataagttacagattagtttgccccttccttcagctggcactggataaataatatgttaatgcatgccaccattttctgctgtggcctgggaagagagggcatatgatgctctatcagctacctccagtgaaagggtctacaaagcagagagtgggagacagcatttgagagcatgctggctgtttctaacctcaggggctggctggactatgtctggccccttctttccagtggtctccacactggatattcagatctgctttcacttggaaccacacatctgcatgtggctaggacccagctaatctgccaaggacatttgaggtgtttgctcctcaatttctagttctctgccccatctatacctttgatgaggcattggacagcaatagcattcttgtctggaaacatgaccggcgggcaaatatcaagggagctagtgccacctacatgatgacagtcaccacatcatggtgacagcgagcaagagacattaggtaaaccactctttgatgtcattccttctgtgtaaaggggaaaaagaggaaatccaatctagttcctattttattcaattactggaatataagaaacatttcaggccgggcactgtggctcacacctgtaatcccagcactgtgggagtccaaggcaggtggatcacttgaggtcaggagttccagaccagcctggccaacctgatgaaactccgtctctactaaaatacataaaaattagctgggcgtggtggcgggtgcctgtaatcccagctactcgggaggctgagacaggagaattgcttgaacccaggaggcagaggttccagtgagctgagattacactactgcactccagcctgggtgacagagtgagattctgtctcaaaaaaaaaaaaaaggaacatttcaaatttgtgattgtttcctttttctatggtgtctaatcagtttcttttatttacttattgttctactttttaaatgtttttgtggggatgagagtcttgccatgttgcccagaactgttctcgaactcctgggctcaggtgatcctcccacctcggcctcccaaagtgctgggatttatgggcatgagccaccatgcccagccagtcaatgtcttaataaaacatcttctgcctgattttcgacaggatgattgttatctacttatctttcaatttaaaattactggccgggtgcagtggctcacacctgtaaccccagcactttcggaggccaaggcaggcggatcacttgaggtcaggagttcaagaccagccatggtgaaatcccatctctacaaaaatgcaaaaaaaattagctgggtgtggtggcacatacctgtagtcccagttactcgggaggctgaggtgggaggatcacctgagcataggaggtcgaggctgcagtgagccaagatcgcaccactgcactccagcctgggtgacagaggtagactccgtctcaaagaaataataataataaaataaaattacctttctcttcattacaaaagtgagctatgacagcaaaacttgctcaatgaataacacaaaaaccctttccacaacaaacacctagaaatgtaaaatataacaacatcacaaatagctatttaatatcatctcccctttcctcaaaccttgtttcctcttctgcatctcactgtcagcaaatgatcttctttctcattgcactgaaaaaaaaactggaatcagaagagagtatcctcctcccactgccaaatctaccaacctccctgctgcctttcctgatctcatccaatctcatggtcatatatataggcttatggctcccaaatttgagtttccaacccagatttctctaatctcaaaaatattatgcctggccaggtacagtaactctcgtctgtaatcccagtactttgggaggctgaggcgggtggatcacttgaggttaagagctcgagaccagcctggccacacggcgaaatcccgtctctactagaaacgcaaaaattaactgggcgtggtggctcacacctgtaattccagctacttgggaggctgaggcacgagaatcacttgaacccgtgaggcagaggttgcagtgagctgagactgcaccattgcactccagcctgggtgacagagtaatactctgtctcaaaaaaaaaaattatgcccagttgtattatgacctttcccattgcatatctcaaatttaacctggccagaacagtaccctcaatctaccccacaagcctgttcttttcccagaattccccatctcggtaaatggtgtcaccactcaattaattgctcagaccagaaacctaggagttgagtcagcctctctctttctctcataccttgtatctaatccttcactaaatatttgtgtctctcccttcaaaatatactttttatctcatgcctagctaaccacaatagccttctaacttatcttcctgtatccactctttactaccttagagtctattctcaactcaacagccaaagtgatccttttaaaacataatgcaggctgggcacagtggctcacacctgtaatcccagcaccttgagaggccaagctgggcagattgattgagcccagcagttccagaccagcctagacaacatggtgagactccatctctacacacacgtgcacacacacacacacacacaatatatatatatatatacacacacatacactatatatatacacactatatatagtgtatatatatacactatatatatactatatacatacactatatatatactatatacatacactatatatactatatacatacactatatatactatatatacactgtatatactatgtatacactatacactatatatactatatatacactatatatactatatatacacactatatatactatatacacactatatatactatatatacacactatatatacactatatatatacactatatatacactatatatatacactatatatactatatatacacactatatagtgtgtatatatatatacacactatatatgtgtgtatatatatatacacacatatatatgtgtgtgtatatatatatacacacacacactatatatatatatataaaattagccaggcatgttgatatgtgtgtagtcccagctacttgggaggctgaggtgggaggagtgcttgaggccaggaggcggaggttatagtaagctgagatcgcatcactgcactgcagcctggaccacagaactagaccctatctcaagttttaaaaaaccaacaacacataaggcaggttaagtcatgcctttgtccaaatcctccaatggcttctcttctcattccaagtaatcgcaaaagactatgaagccctggctaatctggcactttgctgcctctggagaagagctgctatccctctcccactccactccagtcactcaggcctccttattgacctttgtacacaccacgtccacttccacctcggaccatttgtagttgctgttatctccacttagaatgctcttgcccaaaatgataccatagctttcttcctcattttaggtctcgactcacgtgtcacctcatcacagaggccttccctgaaaaaaaaataaccactcaccccactcccgggacccccccatccccttaacctgctttatttttctccataccagttcacaccctctgacatcatagtattacattttctggattatggtctgtttcccccaaatagaatgtaagctcaataagggtaggactttcatcttgttcactgctgtatcttcagctcctaaaacagtttccagcacatagtagatgctcaataaatatttgttgaatgaatggataaatgaaaggcacaactgagtgcaagaaaaatagagtccagaaaggatgaaggaaatgaaaactagagggacatgcaggtgaactgtgatctagtgattcgagattcaacccctgtggccaagactattagttctgctctttcttttcctttctttctttttatttctcccttcctttcttcctatttttttttttttttttttttttgagatggagtctcactctgtcacccaggctggagtgcagtggcgcgatctcagctcactgcaagctccacctcctgggttcaggccattctcctgcctcagccttccgagtagctgggactataagcgtgtgccaccacgcccggctaattttttgtatttttagtagagatggggcttcaccg[136 bp omitted]tctctttctgctttccttttctttctttctctctctttctttttgagacagagtctcactctgtcacccagtggcgcgatctcagctcactgcaagctctgccttctgggttcaagcaattctcctgcctcagcctccggagtagctgggattacaggcatacgccaccatgcctggctcattttagtatttttagtagagacagggttttgccatgttggccaggctggtctcaaactcctggccgcaggtgatctgcctgacttgtcctcccaaagtgctgggattacaggtgtgagccactgcacccagcccaagactattagttattttctaacacccattctcctctacgtccacagaaatagaactactaatttttaactgcatacatggctacccagagtaatgaccactgtgactaacctctcaccaaggggatataaaagcaaatttcatgtggaggtactgggaatctcaaaagatagctgccatgtccctttcttcttggctctttagtttttcctattggctggaatgtgaaagtgaagcctagagctggaggaaccatcttggaccatgagatgacctgagaaatagaggtcatatagagtagagcaacaagatcaaaggaggctggagtgcctgagaacattacgaggacaaacagtccacactggctttggactgcctttctctagactgttccatgagagatcaattttcctcttgtttatgccactattattttgaagctctgtttctctcagctgaacctaatactaaccaatacgatgaacatacagagagaaaagccaaggccctggaaccaagaaccccatatacagactggatcttcacttaccctttccctcagtgaaatggtgaattagaaaaaaatcatatcagacttggggggtgcgggtggctcacaactttaattccagcactttgggaggccaaggtgggtggatcacctggggtcaggagtttgagaccagcctggccaacatggtgaaattccgtctctaccaaaaatacaaaaattagccggaagtggtggcacatgcctgtaatcccagctactcaggagcctgaggcaggagaatcacttgaaactaagaagtggaggttacagtgagctgagattgcacctctgcactccagtgtgggcgacagagattccgtctctaaaataaggctgggcctcgtggctcaggcctgtaatcccagcactttgggaagccaaggcaggtggatcacgaggtcaggagttcaagaccagcctggccaacatggtgaaaccccgtctctactaaaaataaaaaaaaaatagctgggcatggtggtgggcacctgtaatcccagctacttgggaggctgaggcagagaattgcttgaacccaggaggcggaggttgcagtgagtcgagatcgcgccactgcactccagcctgggtgacagagcgagactcagtctcaaaaaataaaataaaaggcagacaccattttttaacataatatctttttgtaggccggtatttaccttcaacagtattatttgcctagagaatgttttcaataaatatttgttagcggtgaaacgtatccatacagctctgcggcaacctcaattcttgcctcctcagaagaattcgactgacgggcgtaagggaaaaggagagagtgaggcaagttttagaggagtgaaagttcgttaaaaagctttacagcaggaatgaaaggaaggaaagtacactcagaagagggccaagtgggtgacttgagagacaagtgcccagtttgacctttgacttagagttttataggttggcatacttctagggtcttgtgctatttctcctcactcgcccaactcctgagatcttatcaggaagttgctcatcaccagtttcaggtgttttctattaggagactgcctttccctggcaccggctgtgaccaattattacttttttttttttttgagacagactgtccctctgtctcccaggctggagtgcagtggtgcaatctcgactcattgcaacctccacctcccagattcaagcgattctcctgcctcagcttcctgagtagctgggattataggtgcacaccatcacgcctggctaattctttttttgtatttttagtagaggcggggttccaccatgttggcaaggctggtctcaaactcctgacctcaagtaatccgtccatctcggcctcccaaagtgctgggatcgcaggtgtaagccatcatgcctggccacaattattactttagaaagacagttaaccactcattgcctgaccatcacgggatggttgcctgacactactggtgtgtgtgtcgggggagccctctcctgccctgctcataccttactagctacctactgtaacatacttactgaatgattgaagagaaacacaagaaagcccacctacctttccatacagaggcaaaaagtttaatttccttggtcaatcaggaaagatagtccccaagactcttttctattgtttcagttttcattaaccttttcgttgagatataattcagtgatttaaagtgaattcaacggtttttagtatattcattgagttacagagccatcaccacaattaattttagaacatttcaatgaaatttacgacattttcatcaaccccccaaaaacacttgtgcccatttgctaatgtgcccattggcagtcactcctcttccctgcctgccctccccccctcagtcttcccgccagttcctggcaactattaaattactttctgtctctatagacttgccccttctggacatcttatataaatagaatcacaatatatggtcttttgtgactggcttctttcacttagcatgatgttttcagggtgatatattcatacaatgaactattatctggcaagaaaaaggaatgcagccaatttataaggtattgcaagatttcagacatatttatacattttattttgtacatttttattgtggtaaaacacacatcacataaaatttaccattttaacaattttgaagtgtacaattccatgatattaagtacattcatatgttctgcaaccatcaccaccatctgtctccagcactttttcatcatcccaaattgaaaactctgtatgtggctgagtccagtggctcatgcctctctaatcccagcactttttgggaggctgatgcaggaggatcacttgagctcaggagtttgagaccggcctgggcaacatggtgatatcccatctctacaaaaaatacaaaaattagccaggtgtggcagcacccatctgtaggaggctgacgtgggaggatccattgagcccaggaggtcaaggcctagtgagctatggttgtgccactgcactccagcttgggcaacagagtgagacgctgtctccaaaaaaagaaaaagaaaactctgtatgcattaaaaaataactcatttcccctctcccagccccttgtaaccactattctactttctgtgtctatgtatctgactattctaggtaccttatttaagaggaataatatagtatttatccttttgcgactggcttatttcacttagcataatgtctgcaaagttcacgttgtagtatgtgtcagaatttctctccttaaggctgaataatactctattgtatgtggataccacattttgtttatccattcattcactgatggacatttgggttgttctcatcatgtggctatggtgaatagtgctgctatgaacatgggtgtacaattatctgttcaagtcccggctttcaattattttgggtatatatttagaagtgtagtcattggatcttatgacaattctgttttattttttgaggaacctccatactgttatccatagtagctgcactattttacattcccatcagcagtacacaaagatctaatatttctacatcctggatgactctttttatcttctgctttttgataatagccaaaccaacctaatgggtgtgatgtatctcattgtggttttggtttgcatttccctaatgataccttgttttttgtctgttttactttatttttaataaatcatattatcagttaaat[143 bp omitted]tactaaaaatacaaaaaattagccggacgtggtggcgggtgcctgtagtcccagctactcaggaggctgaggcaggagaatggcatgaacctggaaggcggagcttgcagtgagccgagattctgccactgcactccagcctgggcgacagagcaagactctgagactccatctcaaaaaaaaaaaaaagaaagaaactgtttacaaaataaataacccctatgtgtctaaaagttgtttaatttagtttgtttaaagtcaagtacatttgcaactgaagaaactaattgctgcagtcatttaagcattaatacggcaggcattgtgctggacagttgtcacaggtgaggttccccaggaagtaaactctgagacaggtggttaagtaaggagtgctctggggatgaatagctgtgggaaagagggaaagcaagcaggaatcaggtcttccacaatttttgaaagtttaaaggggtctctagatcaaaagtttcagagccactggtctacagcatactaggagaggtaaaacccccgcagagtcacttcaaatcaaatatttatctggctactaatagtggaagaccctctctcctgttcatctctctcccgctctcattccctactttctctctgtctctctcatctcctttccttttcccactctttcctaaaactatttcctatatgggtttcactctgcatccccgtgtgttggtctcccgtttatgttcatttcaccttctactcctcaaatcttttctgtggattgcaagatactgtgtccggaattggtgggttcttggtctcactgacttcaagaatgaagccgcggaccctcgcggtgagtgttacagctcttaaggtggcgcgtctggagtctgtcccttctgatgttcaaatgtgttccgagtttcttccttctggtgggttcgtggtctccctggctcaggagtgaagctgcagaccttcgcggtgagtgttacagctcttaaggcagcgtgtctggagttgttcgttcctcctggtgagcttgtggtcttgctggctccagaagagaagctgcaaatcttcgcggtgagtgttacggctcataaaagcagtgtggacccaaagagtgagcagtagcaagatttattgcaaagagtcaaagaacaaagcttccacagtgtggaaggggaccggagcgcgttgccactactggcttggacagcctgcttttattctcttatctggccccacccacatcctgctgattggtagagcccagtggcctgttttgacagggtgctgattggtgcatttacaatccctgagctagatacaaaggttctccaggtccccatcagattagttagatacagagtatccacacaaaggttctccaaggccccaccagagcagctagatacagagtgtcgattggtgcactcacaaaaaccttgagctaaacacagggtgctgattggtgtgtttacaaaaccttgagctagatacagagtgccgattggtgtatttacaatccctgagctagacataaaggttctccaaggccccaccagagcagctagatacagagtgtcgattggtgcactcacaaaccctgagctagacacagggtgctgattggtgtgtttacaatccctgagctaaacataaaggttctccaaggccccactggagcagctagatacatggtgtccattggtgcactcacaaaccctgagctagacacagggtgctgattggtgtgtttacaatccctgagctagatataaacactctccacgtccccaccagactcaggagcccagctggcttcacccagtggatcccgcactggggctgcaggtggagctgcctgccagtcccacgccatgcgctggccctcctcagcccttgggcagtcgatgggactgggcgccgtggagcagggggtggcattcgtcggggaggctcgggctgcacaggaacccacggaggcgggggaaggctcaggcatggcgggctgcaggtcccgaggcctgccccgtgggaaggcagctaaggcccagcgagaaatcgagcacagcgcccgtgggctggcactgctgggggacccagtacaccctccgcagccgctggcctgggtgctaagcccctcactgcccggggccggctggccggccggccggccgctcgtagtgcggggccctccaagcccacgcccacccggaactccagctggcccgcaagcgctgtgcgcagccctggttcctgctcacgcctctccctccacacctccccgcaagctgagggagcgggctctggccttggccagcccagaaaggggatcccacagtgcagcggcgggccgaagggctcctcaagtgccgccaaagtgggaacccaggcagaggaggcgctgagagcaagcgagggctctgaggactgccagcatgctgtcacctgtcaataccaaattgctcctgtttctatgctcgcagtatcattgtctttgataaagatagatacgatagattatatatagtttgttttttagaacttctgaataatatagaggcattttgttattgtagatgcaagcagtcagaaatatattgcatttcatctaccttgtaagttgacattgtagttttgtaataaagaaatttcaaaaattaccaacagtgtctatttaaaatttaccgtgaagaatgatagcacatgctgagttgtcatcaaaatattggactctcaagttgtcgtgagactcgattgaaatatggaagttcggcacctctgtttatttcaatccaagtgtggaaaccaccagaaaacagaaaagcacccaaaactccaccaagtgccaatgttcctccagtgacacaatgaatcttgaaagtacgtcatgctacaaaggacatgaaaaagcaaaatctaaagcaactagagaaaggaatctctacagcaatcaaataccaaattagaagaaggctttttgttgtcgttttgttttgtttgaagagtttttgcttttttggaaacaaaatgttttgctttctccatgcatcatgaaggaaacaaaaatacacagcttgttaaatttagttgcggctctgtcacaacaatgatgacaaaattttcctctgaccacaatgtgtttgagtacaaatggttcctctttccaggctctggcctgtgcatacacaaattcctagtgaggtgagacccactcccccacagcggggctccttctttttttttttttttgagacggagttttgctcttgttgtccagattggagtgcaatggtgcgatctcggctcactgcaacctccgcctcctgggttcaagcgattctcctgtctcagcctcccgaatagcttggattacaggcatgcgccaccacgcccggctaattttgtatttttaatagaggcaggg[136 bp omitted]agctatccttcatacatgaaggtgctaaggaattcaactgtatcctagttggtgaacgctatggcctttaaactcattcacaaaaaccggtgatcccagctgatctaattccaccatggccagccaggagtggtgcccagcgttggctatgtgtacctttgccagcttgtggagtggggatcagtagacaaggcactcctccctgatcctgtccctgctgtgccaccaagcccctttacattgactctcttccccaaaagggcttcatcattgcagcttgtgcatgtagcttgcctggggatgaaagggtaagaggaaacaggaaattgagtggcaataaaggagaaatgaaagaaaaaggactaagaacaaatgggacaatgtcagcagaaaggagaacaacagaagcggaacctcaagagacaagggaactgtaaagatgaaagagtactagaaattctaataatagttcccatttattagtgcttattatgtgctaggcactggataagcattttatgtcagtttcttcatctcatttaatcgttacaataaaccctgtggtaggcactattatagcattatgcctggtttacaaaagataaaacatgctcttgttatttaaaaaggccaaaaaaaaaaaatgcccacaacatttaacacaattctagaaagaagataaaaagaaacagaaaaatgggacaaatagaaagcacagaatcagatggtagatataagtataaatatattagaagtctggctgggtgtggtggcttatgcctgtaatctcagcactttggcagaccaaggtgggaggatcacttgagctcaggagttcaagaccagcctgggccacgtagggagacccccccatctctactaaattaagaaaaaagaaagaagtaaatctaagtgaactaaagtctacagttaaaagacaacaattgcctattggatagaaaaaaccgaatttgcactttatgctgttcccaagatcagacccaaaacataattgcactgaaaggaaaataaggatgtaagaaaatgtaccaggtacatactaaacaaaagaaagttaatgaagttataataaattagtcaaaatacacttttaagacaaagaatagtacttcattaatgaaaggtacttcatagtgataagtggtttggttcacgaggaaactataacaattctagatttgcgtgtatttgatgaaatagcgtcgaaaaagatatataaagcaataattaacagaattataagaagaatttgacaaatgcaccctcataatatcatagtgagaatcgttaacaccctcagtaattagcaggtccaaaggaacaaaaaaccagcaagtatgttgatttgaccaacacaatccacaaacttgacttaatggaacgtatagaacactgggcccagtaattggagaatatgcattttcctcaaacactcatggaacatttacaaaaacaaactatatgttgtgacataaagcaaacctcatcacactcgcaaagattggtaccatcctggaaactgggaataagaagttaaggaggggtccttgcttctgtggctgagaagtagcaaggctggtgcagcatagcaccagggatgccaatgaggtcacactgcagtcaacttgctctatgactgagggtcggaaaaggcagtccaggtcaacgactatgggaaagatgggtttatgcagggactgaactggggtgggttttgctgctcctccagaagcctggtattttccaatccacaaatgaggcctcaattctgtgcttgcacagggatctgtccaatagctagatatgcagagtgacctctggggatgctattgggatatgcaaatgacagcattaatggggtggagttacagatatgcaaagagccccctccttggagaggtgttgtggattggggcaagagggactagaggcttctttgtttaaatgaaaatactaattgccctacactttcaaagcaaacaatggagacctttcaaggcaagaaggtgcaggtgactaacacacaaatggagcatttgaatctttctttctttcttttttttttgagacaatcctgctctgtcgcccaggttggagtgtagtggcgtgatctcggctcactacaatcacctcctgggctcaagccatcctccagcctcagcctccagagtagctgggactacagcatatgttacagttcctgactaattattattattttttttggtattttttgtagacatggagtctggccatgttgcccaggctggtctggaactcctgtgctcaagtgatctgtctgccccagcctcccaaagtgtgaatgtttaaactgaggaaccctaaggccgaggagagatcctaacgccagggaactgagtggcaaagcactaacggggctggtaaagtgtacaaggattggacctgtcctgcctggaccagaacaggggacaggccctacatagagttttagatccagggtggggaaagtgcagtgaaaaggttgtaggggatcctggctaagatgccagggtagtggtagtggcagtgatgatagcaacgcagccagaagccaaaggaggggacctggatgctaagacacagaggcccttcctctttcagagactgaagtgttggaaaacagagcaaggccaattccagagaggaagggttggcagcctggaggaagtgaggccagggagcttctgaaaggaataatgaatgctttcaaggggagcaagagagcgtaggggctccaggccccaggaacatgctcctgtgtagagcagcaccccaagtcattttgcccagggaagaatcagcctcctggcacctgggctctgactgatggagccagcagtttgcctggaggctggccctgtccctggctgccaacacctcaaatattctttcctgggccttcttacctccagacaagaattaacaaactcttggtaattcatcttagaaagcaaaacaccacgtattatgtcagcatcttgtttgtaaaaagcctgctgtgacttcttattgcttatgaggtcaagccataaactgactgctctctctctctctctctctctctcctcctaacctccctctctcattctggtcatccttcaaggtctagttcaactcccatctactgtacgaaaccttcaaaagcacaggcctgtgtcacctttctttgaacccatatcacagatgagcatttgtaccatttttgtttgtttgctttttacattttctctaattgctctctatacctttccacaacttagaccaggagtttcctaagagcaggcctttggtttgttggttggtattcctcacagcacctagaaaaatgtacaatttatttattcaattaaaatatatttattgagcatgtattatgtgccacatatagttttgagtgctggggatccagctgggaaccgatcagaaaaaacttcttgccctgatggagcttacattctagtggagacagcaaatgacccaggaagcggaaggagagaaaggaagtggccatggggcttgcagttttcaatggggtggccaggacaggtctcagtgagagatctgacagaagccagggagtgaggcatgaggatatcttgacggggagagagcaaatagccaaagaaaaagtcaaggcaaaggccctcgggcaggagtgcacttagcttgtgtgaagaacagccaggtggtcagtgttgctggaggagagtaagggagccaaggagagcagtaggagagaaggttagagagataatggggtcagatagggtaaggccttggaagccatcttgaggactttagcattggagatttctgggtaaagggagt[137 bp omitted]atggcgaatccccatctctactaaaaatacacagattagctgggcatggtggcatgtgcctgtaatcccagctacttgggaggctgaggcaggagaatctcttgaacccaggaggtggaggttgcagcgagctgagattgcactgcagtccagtctgggcaacagagcgagactccatcttaaaaaaaaaaaaaaaaaaaaaaaaaaacctgctgtaaagtttggaggcccacaggtctacgggtttcaggacactgacccagtcacctagaagcgtgcctactctcaggcaaaacccaaagggtcctgtcagtggcctcttgtgcaagcaacactcccttgagtgaactccactaaaactgtagaagaaaaccacctgctgaagagcaaggacctttaattcaattaaacccaaacattgagaatgagttatgagccactaaccatgttccattcatctttatattctctgtggtgccagaggatgcctttctccaagctcccccgactcaatccactcagaatctaagtaagagtagagctcttgctgtacatacatggctccaagacaaggcccctggggattgttccttccaatcagattaccaccactaagctcctcctaggtagaaaacctggagtcaccctggacagtctgacctccaggagcttgaatccagtggcagaaatagacatgcacacaaacctctgtgtgatttgatatgatagaggaacgtgtctggtgctatgagcacacacacaggagggagcaaagaattttgcatttgggagttagagaagcccctaaaaaatgtgacacttgagaaatggaaaagcattttagataaagggaacagcaagataaaaggtttgcagtgagaaaatatcacaggtgacaaacaagaaccgggcaagtcataagtgaggaaacgctgactaggccagggagcaatagggagccctagggcatgtgcagacaggaagtacatgccctgttaacaaggtggcagcccatctgacatctgctgacggtttctacactgaaacaggtccaatattaccaggacttttgatttattaagagaagctggaaatctggggccttaggcaaaatctcctgacttaaaaaaaacactttggcatctagatccccatgaattccaacatgatatggaccaaacacaattgctcacaagggagattcagcctgaaggtggccagtcagccacctggaacctggaagcttggctggaagtgaagctaggaagagtgtggggaatctaacctgaagaggcaagcctgcaggcagaggagttgagactgccttttgtggcatttgatgaagggaggggtgtcacttaagcttaagctgaggagtgacatggacagattgctcattgggaagatctgtcttgtaaagggtagaccctcatggccagtttgaagactgtttctggaatggtaataaagtcctgaaatagaaccatagaggcgaaactgggtggtcgggggaggaatagatctgagagatgttttaccatctaatcagtgactgcaggactagacagtggatggggaactgggggtacgagatacaggaaagggagttgtcaagagtacatacttttagcattcatctctaattttggccaggcatgggggacagtgggtgggtggggaccaaatacaaaagacaacaaagagtattctagcttaggatctctctcacctttggcgctgttgtcatcttgagtagagtaagtctttgttgtgggggcggtcgtgtgcattgtattaacagcagcatccccagcctctactcactgcattccagaagcatgcccccgcttcagtcatgacaaccaaaaatatctctccatattgccgaatgtcccctgggatgtaaaattgcccctggttgggggccactgatccagaatcgggagggaaattccctgttttcaacttctcctttttctttgttttgcagtggtgtgaggttttgcttagaggactctttgtgagatttttgtctaagggaccagcacttttagctaagcccttggaatatgctggtgtctgtgtcccttttggactcaggaaggtgtctctaaatggatggaaggacacctgactttggaaagagggacatcattctttcctgccagacattttcttgcatatgcccttttcagcctccagttacagaaatggacgaagacttagtgagaagggcaaaggtcaaaacagttgagtggagtggcctaggtacacagggcagcgcagaactccagccaccccgggccaaagtgaaagaaaggccactggtagtctcgcacccaagtcatcaggactctaagggttaaacttgatgttgactcatcatgattttgatttacacaaagccaaactgaaagctccttgtctactgcagttcctggaaagccttctatctgtcttcattcttcctgcagaccagggcagtggcctgattcaatccaagacgctcttcgaatcacactacacggagattacaaatacaagttttatgttgaagaaacagcattcctgactctttccacccccttccaaaaatttgaaaaatcgttgcatgatgttcagggtcgggaagaaaggaaagtaacaatatagtcttaaggccagcaggccggaactatcttggtgaaaagaaatcaggtctctcccctctccacactgccgtttgttttttttcctcacgatgttcagattctcagggcttttctggaagctcatgacaagctgcaatccctatttttctaatcatttgctaccattactgttttattaagcgcttggtcaatctatgccaagcagtgcccatgatggcactcagccagtccccaggggctcctgttccaactaaagactccttaaaaggcagatgacataaccattttggaaacgttattataaacttattgtataatgtttatagcaaatgtcaacaagtgtatatgtccgtggtggtggaggaaaggccttgggatacacagtggctgacctatttgtgggagggatttagaaataatgatactatctctcagttctacaggccttgatactttacaaactgttttcataaacattattttgttcgataacacatgcaagccaggatttattttttttttttttgagaacggggtctcactctgttacagacccaggctggttttgaactcctgggctcaggtgatccttccacctcagcctccagaatagctgggattacaggtgcatgccaccatgcctggattctggaatttattctgaaccgttagccaaaagaatcaacatcctgagattcagcacaggcaggccctcctcctggaagcttcccttgctccttccctcccaaaaggtaccctttttgtatcccataattccttgttcttgcccttatcattgcccctcagactgactgcagctttctgttagcagagcttgcttttggtgagtgtcttcaacagttcctggaacaatttcataaatatttattgagtttgagagccttaattccaagagtggaacctttgttgtgaataggttaaacaaccctgtgccctttgggtggggtctagactaggtatattatcagcatttttattgctatactttttgtaactgttttcaggtatatgcattggcttaattcggccaaaatacacctcattatgggtctcatcatccacctagacatgattcttttttgggagaaggtgatagaataatgtccccctcccatgattccatatcgtgatccccaacacctgtgaatatgttaacttacatagcaaaaatgacttttcagttatgattaaatcaaggattttgagatggggagattattatgaattatctggtggacctaatctaatcacaagggtatttataagggaaaaggggaagtaagagggtcagagtcagatacgacaagggaagcagaggtctgagtagttccgcaacaagccaaggaatgtgggtagcctctagaagctggaaaagtcaaagacacagattctcccctagaatatccagaaggaatacatctctgcccacaccttgatttaagctcagtgtcacttctgacctccagaactgtaataaaataaaactgttaaatcactaaatttgtggtcatttttgacagcagcaacaggaaacgcctaaggactcttgttttccttcctcccagcctcactgaccctcataggcgcccaagtatcaatgtgtattcttccgattcacctcccatccctttgaaaaatatgtagaaagtttgtcgtgtgctttaaaaaatgcacgtatggtatcctccctcatgtttggaatgttccttttaaaatcaacattatgtattgccagctttcaaatatgccctttgtccttttcacaaagcacagtactgccagtgtccccaactccacccagtgaagtagggctggtattactaaccctggagtcagcgctagcaaacaagggctcagaggtcaagggctggaagccaggtctccagactcccaggccaaggctcttttccgcagatgactctgtcctggtgtccagcagggcacagcccctagcacctccgaggccccgcaagtgtgctggcagcggcgacgccggctccgccacgcggagggaggaggcccaggcagcgcccggagtgggcggcgacgtggtggaagaagttttgttcggtcagagaccggacgcgggagctgcgggtgggccaggtgtccagccttgggagccgtaggagccgccagagccgccagagccgccggcgccccgccccgcctcctccggccgctctcgccggctcaggttacctgaggccggtgggcggggcggcccttcccgtctgcgccggcccccagcctccagggcggcggagccgggaagtggaagagggagcgaaggaggcggggactgccaaggctccagcccggccgggctccgaggcgagaggctgcatggagtggccggcgcggctctgcgggctgtgggcgctgctgctctgcgccggcggcgggggcgggggcgggggcgccgcgcctacgggtgagtgcgaccctcggggcccgaggggcggccggagggctgagggcggtgagggtcacggctgaaaggccccggaggtcaacgccgggcggagggccgaagctggggtgggtgctgggggctgccctcgcgaggccccgcgctcggcggctgcggcttcccgcgcgggatctctggggcccggtactggggccggttcgaggtgggacccgggagctgcggggttttcccgaactccgggtgcggcggaggtggcggcagcgaagtaagagggctgcgacttgtagtgggaagagcccaggaggctggcgtccaggcgtgcgggggcggggggcccgaaacatgcccacggcgtcagagggccgtgggtcagcgcccggaatgtcgcctgtgagcccgggaggaaatgaggcgccagagccggcggggaccacgaccgaagtccaggcgagctgagaacgcgccggggctctttgcccgaggccgcgccaatcctcactgtctaagggtggctcttgcgagtggaagttgaagggaacctctaaacatctcagtccttgttgaaaaaggacgtgacgctcatgacctcctctggcgtcgaagaaatcctttgggaaatccagaatagcatcccggcagatgctccccccaccccactctctttaataaaccttatattttagggtaattgtagatttatggaaaagttgcaaagatacttcagagagttgtgtatatccctcaccctgtttggtaacttctagttaatcaacctggcagttgtgaaaaattgggagttaatgacttccttaggagcagctcctggaaggaatggccttctggacgtttttggtgacaatgaaagccccaaactgtataggttttattatcacattgacacaaacacttatatatgcttattgcatttttaccaatgtgctttgaaatccaagttgaaatgttgattaggaaaccttaatgccctctatggattcagtcaataaaatacatgctgccaggcagtgtttaggggctgaggatgcagcagtgagcaaaacagatgaggtgcctgccctcagacatatcggggggtgggggtaaaatatatgatatgtctgagggtgttaagtagagaaaaacagagcaggtgggaaggggtttgccattgtaaaaagggtggatcgagaagaaaacaaatgttgctgaaaggtggcatttgagtagagacctgagggagacttgaagcttgtcagtcaataattattcaggtgtctgccttatttagtactgagtcaggccctctaggttgacttagaacctgagagtgtatagcaaaattcttgccccaaaagggcctctagtttagttgggtacacctgatttccgtaatcatatggggacattgcagtccagagaagggaaggaacttgtctaaagttacccgtctcattagtctcctgattttcacagtgccactccagcaccctccctcctacagactcactcccacacacacctgaaacaacagctggccatctagagaatactggcaactcccaacttcatcagtcctgtcacaatggtttgtcgttagcttgcttatttagaaaacaaacttctttccccattaaaagtattgatagaattgcattgaggtatggtgggaaaaaattagatgtttccagtgagacttgagttttagtggttctgatatttaccacctgtgggactctgggctggtcatttcctctcttttgtgctgcagttagttttctcatctgtgaaatgaggaggttgaactgcataaattctaagagctcctccagctctaatcctcagagtgtttataaaagtgattagattactagcttagtttaacctgtcccactcaatggcccacattgtggcatgtcttaattataactagcatgtatatagcatttatgcccagcagttttctagctgctttacttgtactatttcatttaatctttaccaataatataacttgtaggtgctgttattagtcccattttgtacacgaaaaagttgaggcacagtgcgaccaagacccttgcccaaattcgcatacctggcaaagtggaagagctaggtttccaaccctggcagcctgattccagaggccatgcccttaaccactgtactcattgcttctgcccagcagaaaagacgagagtccttagctggacacctcccagggtagcagggcaggacggcttgggacccacgaaagtatgtgcaagccatttgttaagaagctaatgatactatattaggccgggtgcagtggctcatgcctgtaatcccagcactttaggagactgaggcagatggatcacttgaggccaggagtttgagcctggccaacatggcaaaaccccgtctactaaaaatacaaaaattagccgagtgtgggattacatgcctgtaatcccagctactcaggaagctgaggcatgagactcatttgatcctgggaggcagaggttgcagtgagggaagatcaggccactgcacttcagcctgggcgacagagcaagactgtctcaaaacaaaaaaagaagcgaatgatactacattggagactggctttatagtggctgggctgtgtggtccaaacaactagtactataggcattcaaaagagaaaaagctgacggttggtagtgttatggaagaggtaaaacttgagctagatcttctggatgactgggatttgagtaggtggagaatttattccaggtgggggcaatagcaggagcagagacccagaaatgagggcaagagtgctcctttgtggtcaagaaggaacctggcttggcaggagagtgcattggtaaagtcaatccaggcagaatagcttgatttgcccttgaaagctctgagtccggcacagcatgggaaaaataacacagaaggaggaagcaagcagggagacttcactgggtaggggagcccctggagtgtgaagctacataagaatctatggttgcaggtctccactagaaaaatgtgctgcgaacccttcctgtccaggaccatgacttactggtatcttcccacctggtggggcacaacagagcatatttgcatgattggggtaactaagaaagatgttggaagaaaaaaacgaacaggagttgatgcctgagtggatgtaagggaagggacagatgactcatatatgactcttgtgatttccttaacttttcccaaaatgtgcatgcctctgctagctgctgtgattggacaggcgagagcaaaagctataagctaagcaaaatgccttcttatgaaatagtagattgtgttaactcttaatttaaataggatgttgtgctagatgactgtacagacttgggatttgaggtttagatacagacatacttgggtcccttcctactcccttttctgaagtcagtggtgcaatccccaagacatggttgaaattaggtgcctaagggaagcttatcaggtagaagggatacttgttctgtctcaaaggccagggacacata[131 bp omitted]cgaaacccagtctctactaaaaatacaaaaattagccaggcgtggcagtgcacacctgtaatcccaactactcggaaggctgaggcaggagaatcgcttgaacccaggaggcagagtttgcagtgagctaagatcacaccagcgcactccagcctgggtaacagagcgagactccgtctccaaaaaaaaaaaaaaaaagcaactctttagaattgttttgtcttaaagaaataaagcagatagctaacacatagcacttgctgcctgtgggcactattctaagcacattgcttgtattaactcatttaatcctcataataaccctttgcaagaggttactattattatcctcatattagagatgagaaaactgagaaatagagaggttaagtaatttgcctgctggcaagtagtagaggtgggatataaactcaggcagtcaggctccagagtctgtgctcttaaacactacactatgttgaagttatacacgaagagctgttagagacctttacaagtagtataatcatcacttaatcatatatatgtctaggcatgttgtatacacacacagttcacatgtatttgtatatatttaaacatttggagattaaagtttcagtgcctgtgtttttttcaattttttattataaaatacacataaaatttaccatcttaatcatttttaagtacacagttcagtgttacgaaatacattcataatgctgtgcaaccatcatcaccatccatccccataactctttttatcttgtaaaactgaaactctgtacccattaaacaataactcctcattttcccctgcccctagcccctggcaaacaccattccactttctatctctatgattttgactactctaagtatctcatatgaatgtaatgatatactatttgtcttttttgtgactggcttatttctgttagcatagtgcccttatggttcatggtgtatcatatgtcagaatttttccttttttaaatttatatatatatatatatttattataccttaagttctagggtacattgcacaacgtgcaggtttgttacatatgtatacatgtgccatgttggtgtgctgcacccattaactcgtcatttacattaggtatatctcctaatgctatccctcccccatccccccaccccacaacaggccccggtgtgtgatgttccccttcctctgtccaagtgttctcaatgttcaattcccacctatgagtgagaacatgcagtgtttggtttttttgtccttgcgatagtttgctgaaaatgatggtttccagtttcatccatgtccctacaaaggagatgaactcatccttttttatgactgcatagtattccatggtgtatatgtgccacattttcttaatccagtctatcattgttggacatttgggttggttccaagtctttgctattgtgagtagtgctgcaataaacatacgtgtgcatgtgtctttatagcagcatgatttatactatttgtcttttttgtgactgacttatttctgttagcataatgccctcatggttcatgttgtatcatatgtcagaatttttcctttttaaaagctgactaatattccattgtatgcatataccatattttgcttatctgtttatctgtcaatggacacttaggttgcttccatgttttagcaatttcacaatactattatgaacctgggtgtagaatatctctttgagaccttgttttcacttcttttgggtatatacccagaaatggaattattgtatcatatgataattctatttgtaatttttttgaggaaccaccatactgttgtccatagtgaaattttaaatttccaccaactgtgcaccggggtttgaatttttccatatcattgccaacatttattttctgttttttgatagtagccattctaatgggagtgaggtgaaatctcattgtggttttggtttgcattttcctaaatattagtgatgatgaacaccttcatgtgcttattggctatttccttatctttgttggtgaaatatctatttaagcctttgcctatttctgaattgaatttttttttattgttgagttttaggcattctctgtatattctggatattaatcccttatcagatatatgatttacacatatttttccattctgtgagtcacttttttctgtgaatattttgatgcacacgttttaattttttccatgaaatccaattcgtcaattttttcttttgttacctacattgttggtgtcatatccaagaaattgttgctgaatccaatggtatgaagcttttgtcttatgttttcttctaaaaattttatagttttagtcttaaaatttcagtctctgatccattttgaattttttttttacttggtattgggtaagcgtccaatttcattctttttcatatggatatccagttttcccagcaccatttgttgaaaagattgtctgcattgagtggtcttggcactgttgtcaaaatcatttgaccatacatgtgatggtttatttctggactgtctattctattacattgatcagtatgtctgtctttatgccagtacacactgttttgattattgcagctttgtagtaagttcagaaatcaggaagtgtgagtcctacagctttgtttttccgtttcaagactgtttggctattcagggttccttgagatttcataagaattttaggatggatttttctatttctgcaaaactatgccattaagattttgataaggattgaattgaatctatatatcactttggatagtattgacatcttaacaatattaagtgttctaatacgtgaacatgggatgtgtttccatatcatctacaaacagagataattttacatcttattttaactggatgtcttttatctctttttcttgcctaattgctctgggtagaacttcaagtactatgttgaataggagtggtgaaagtgggcatctttgtttcattcctgaccctaaaggaaaagctttcagtctttcaccattaagggtgatgtttactgtgggtttttcatatataacttttaagtcaattttcttacactcctagtttgttgagtgtttttatcatgaaaagtaaattttgtctaatgctttttctgtatcaattgagatgatcaggtagttttttcccctttattctgttaatgtggtatattacattgatcaagttttgtatgttaaaacatctttgtattccaggaataaatcccacttggtcatggtctataatccttttgatatgcccgtgtattcactttactgctattttgttgagaatttgtacatcaatgttcataaggcatatgggtctgtagttttcttttcttgtagcgtctttgtctggctttggtatcaggtaatgctggcctcgtagaatgagttacgaagtttgagaaggtttggtactagttctttagatgtttggtagaattttatctgtgaagctatcaggtctagggcttttctttgttgagagatttttgattactgattcaatctccttactacttataggtctgtttagatttcctatttctttgtgatttagttttggtggttttgtgtttctggaaatgtgtccatttcatctaggctgtccaatttgttagtgtacggttgttcatagtactctcttataaccctttttatttctctagaatcagtagtgattctagagaaatactcattttcatttttgaaaatgagtaaagttctcattttcatttttgattttagtaatttcagtcttctttcttattagtccatctagctaaaggtttgtccgttttgttgatcttttcaagaagcttttagtttcattgattttctctatttttctattccctttttcttttatctctggtctaatcttcattatttccttccttatgatagcttaagattagtttgttctttttctagttacgcaagttgtaaagttaaggttgctgatttgagatctttcttgtttcttaatatgtgtttatagctataaatttttccaatagtactgctttcgctgcatcgtctacattttagatgtttatatttacgcctttcatcaaatttgggaagttgtcatccattatttctttattttctttttttgagacagagtctcactctgtcacccaggctggagtgcagtagcacgatctcagctcactgcaacctctgcctcccaggttcaagcgatgctcctgcctcagccacccaagtagctgggattacagatgtgcaccaccacactcagctaatttttgtatttttagtagaactggggtattgccatgttggctaggcttgtttcgaactcctggacccaggcaatctgcctgccttggcctcccaaagtgctgggatgagccaccacacccggctcattattttttcaagtattctttcttcctctttctctctcttctcctggaacccccataatgcatacactggtctgctgatggtgtaccacaggtctcttagactctgttcacttttcttcaatctttttttctttctgttcctcggactcaataatttttattgccctaatttcaagtttattgattctttcttctgcctgctcaaatctacctttgattctttttagtgaatttttcatttcagttgtgctttttctgctccagagtttctttttggtctctttttaggttttctatctctttattggtattttcattttgcttacatatcattttcttgactctctccacatcttcctttagttctgtgaacatctgaagatatttgtttcagaatctttctttaatatatttgccatcaggtctttttcagggacaggtttgctgttgtttaactttttttctttgggccatagtttcctggtttttttgttttgttttgttttgtctgtcttgtgattctttgttagaaactggacatttaaatctggtttctctggaaaccagattcccccttcccccaggatttgctgttttttgttattgttttgtttattgtctttatttttttgattattgtaggctgtctgtgtgttgagcatcaacctgaagtgtaaacttagtcttctcaggtttttttctgggctttccctgagcatgtgtggtcactttctgtttttctctgtatatatagttttgtttcattttgttttgttttgtttttgagacctagtctcgctctgttgcccaggctagagtgcagtggtgtgatcacagctcactgtaacctcgaatccctgggctcaagtgatcctcccacttcagtctcctgaggagctggaactacagattcatgccaccacacctagctaatttaaccaaacaaacaaaaaaaattgttttggtggagatgggatctcgcagtgttgccagggctgatctttaactgctggcctcaagtaatcctcctgcctcggcctaccgaagtgctgggattataggtgtgagtcaccatgcccagcctctgtagttgtttaagaatttctaatctttaatgcctggctcccaaaagtggaaaaggagaaaaatgaggcgacaagggaagagcgccattcttttacatcttctggaaatcactttagctagatagggagggcttgcaacagtggggataggtgcaaccacaatggctgccagcctctttgtctgtacctctgtgatcagaagcagcaatcagtaatcagaatacaaatccctgatatttggaggacagagtacttctgcccacatagcccacaagctgtgggcagagggctccaggaacatgtgcacagccgcctgccatggggttggggatgaaggatgggcagctactactatgtaaaagctgacattgattgaaatttatggcaatttgttgttcaagcctttcctgggaaattgcaagccttcaatgtaagtgtttcctgatataactctgcagtcttccaaaattgttacatcaaacagactctgccactaccattgttatctaggtgaggagatagatgtctggtgcttcctactcttgccttattcccagaatccatgtgtgtgtgtttttaaagtgtaggaagtagaaaaatcaaaagatatggaggaaaccagaagagaaaaagaaaaggatagcagatagccccaggaagcccaaaatgcaaaccagttagaagatctgaccaaaggacacttcaaaacagatgggagaatattaatcccatttgaaaggttgaatatagggcaggccattgttttatttcaaaactgaggttaaagtaggttttaaattaccttgaaaataaattggagtacaattgaaatgaaccacaaataggtatatttttattatcagggctttaatatttgtgtgggagtgggaggtaggtgggtagggagagtactggaagtgctaaactaggtttcttggatgtgtttctgggaactgcagaataaggcagataatcctacagtaaattgtagtctccagtaggaacaatgtttttattggaggctctctacctgacaaatgatttgtcttcaaaaatatcattgatatggtgttagaaaggccaaaatggaatagccatacatgcttttaatcacttaaaatcctaactttagcactgttgcctgagccattggtgctccctggtactagctcagttttaatgcagtgcaataggaattctttgtttccacaaggccttgtcctgctgtgggctgctccttcccacagttggaccttgggaaaaggtagagttagaagagggaatgattttttttatttcaaattttattatagattaaagggtatatgcacagatttgctacatgggtaaactgcatgacgctgagacttggggtccaacaatctgatcacccaggctgtaaccatggtacccaacaggtggttcttcggcccccaaacccacctccctccctcccttgtctagtgatccccagtgtctatcatttccatctttatgatcatgtgtattcagtgtttaacacccacttatgagtgagaacatgcggtatttggttttctattcttgcattagatcacttaggataaaggcctccagctccacccatgttgctgcaaagggcatggtttcattctttttatggctgcgtagtattccatggtatatatgtgccacattatctttatccagtccactgttggtgggcacttaggttagttccgtgtccttgcttttgtgaatagtgctgcagtgaacatacaggtgcatgtgtctttatgatagaatgagttattttcctttgggtatatatcaagtaatggaattgttgggttgaatggtagttctattttaagtccttttttttttttttttttttttttgagacatagtcttgctctgttgcccaggctggggtgcagtggtgcaatcttggctcactgcaacctccacctcctgggttcaagtgattcttatgccacagcctcctgagtttctggtattacagttgtacaccaccatgcctggctaatttttgtatttttagtagagacggtgtttcgttatgttgtccaggctggtcccgaactcatgatctcaagtgatccaaccgcctcagcctcccaaagtgctgggattataggcgtgaaccactgtgcctggcctattttaagttctttgagaaatctctaaagtgctttccacggtggtggaaccagtttgcatttccaccaacagggtataagcattccctattttccacagcctcatcaacatctgttttctgacttttaaataatcaccagggaatgaatgttgagggtcaagggcctttgtagactgctgaccaagtagctgctatgtataaaattgactgttagagaaacctcaactacagagtgtctgtgagtttgatgttttgatgttttgggacaaatggaattttttgctcagttagggaggaaggtaacagtataaatattgctgattatgtaacaggcccagtgcactccaaagtattagcatagagtacaagatttaactctatcatttggtaaattactattactataatccttaagtaattaataatggttccgttcatcactttagaaaatttgggggaattattttcaaataattttaataaacttctatgttgaaataatttttgatttacagaaaagttgcaaaggtgggacagagggttcctgtatacccatcacccagtttctgggggatgattttgatagtctcaggagaacttctcaggaaagtttaaaatgatgtttcacagttcctcctctttctcttccctcttcagattagtcaaagctctagctccagctgtttagtgtcagacctcaggggaacaagggctgctaagtctctttctcagtacttctttggaaaagctataaaaaaacaattaccaggtcatgttagcaagcagaattaaagatgagcttcttaaacttacttatagaactgctgagattttgaacaatctgattttttgttgttgtcattgtttttgagacagggtcttgctccgtcacccaggctagagtgcagtggcatgatcttggctcactgcagcggcatgatcttggctcactgcagcctcaaactcccgggctcaagtcatccttttgcttcagccccccagtacctgggactataggcatgtaccagcatgtttggctaacttttgtaacttttttgtatagatgggattttgctatgttgccggggctggtctcaaactcctgggctcaagccgcttggtctcccaaagtgccaggattacaggtgtgagccgccgtgcccagtctgaagagtctgtatggagtgaggtgtggatcccaaggttagggaaccccaaattcctggaagagaacaacttggaaatattagtatttaagaatatcactcttctctatggaagtggttaagaatgtgaccttggagccacacttttcaagtgacactcccagctctgccgtttactgtagccatgggatatggaacaaattacttcacctgcttgttgcttcagttgcctcatctttaacatgaggccaataggccaggtgtggtggctttatacctgtaatcccagaactttgggaggccaaggtgggcggatcacttgagctcaggagttcgagaccagcctggccagtgtggcaaaaacccatctctactaaaattacaaaaattagccaggcgtggtggcatgtgcctgtagtcccagtaacaggctaggtgaatcacttcaccccaggaggcagaggctgcagtgagctgagatcgtgccactgcactccagcctgggttacaaagtgagattctatctcaaaaaacaacaacaacaaaaacatgaggctaatactagtccctatctccaagattgttgtgaggattaaatggattaatatgtgtggaatatttagaatagtccctggcccagtaaatgttagatgttgttaactcagttattactgtcttgtcctctaggacttgggagaattaagcaaaccattaaaaatactgttgataaattcatttttttttgtccttgatttgaacagaaactcagccacctgtgacaaatttgagtgtctctgttgaaaacctctgcacagtaatatggacatggaatccacccgagggagccagctcaaattgtagtctatggtattttagtcattttggcgacaaacaagataaggtaagttttctgcaacatgttacattgatgaggtaaagtgaacactatgaattggagccaagaataagccaaattctagtcttacgtcaaagtggaaattgtattttagggtgtgtttaaatttcagttggggaaattatagaagcaactattgacacaagtgaacacttaaaaatatttgctaattatttgacaattaaatgcaattgagattgctctgacaggaaatactagatatctttttctctaaggtactcaataaataattatgttattgttaaaatttgttcctatgttcctgcctgtagctgtattgccttgtatctatataacacttaattttggggaatttttacatttaccatcttgctaatcacatggacaaatagatgtacaggcactatgtggtgtaaaagtaaacggccatatggaaagtgaaaaagtaagttgtcagtggcaggtgtgtttgagtagagggttctgtaatgcccgcggaaaaaggaggaagactttcaagatttctagtcaactgatataagtgaatttttgttaataggtttggataatttcaggtcctttatgataatcttattcaacttttttttcaaaatctttttataccttctttcggtgtgtatgtgtttgttgcagggtggcggcggtgagtgggttgggtgtttggggttgaatttgtccaggattttgagtaggcagaatgagaagttattagcaacagtgctttgcatcagtgaattgtagaagcaccaagttcaggcagctttggtggcaggaagtcaggagaactagcttctgattggcactgtcactcttagctgactctatggcctggaataaattgcttaacctctctgagcgtttgtttccttatgtataaagtatggctttactcacttcgctggcttgctgggacacagaaaataatgtatatatacaaaagtttaatagtcaggatggaacatgctcttcctctggagggaaatttgctaatctgccttcctctcccttgtcctgctgaggtgttacttatggtttaggcgttaattgataaagaattgaggcttatcagaagtatttgcattttaaaagaggtcttctaaatgtggaagccaatgatactactagcagtgagactggagtttgcctttacatactgtcggcttcctcttgttcctcctaaggaagggccttaggcatttggagtcttagtggtgatttttggtaattgagccttgagaaattcacagaaagaccctaagtgcctctggctgtaagccctgtaatcacccaagtgtctaactgaaaccctgagcagaggttgcttttcaggtcccttttccttaagttgtcaaggatcaatcaggtagccaggctggtgttctagcctagaaatggggctatttcctcagagtatgtgcagaaatctagagttaaatgtaactttaggagacagtagaatcagatagaattgtgcttgaaattttatctcttcccgtttcaagctgtttgattttgggcaaatcacttaacctctctgagctcccattttcttgtttataaaatatggggttgttttggcggggggcgggtaataatagtaccaactgaatatggatggtgtgtgcattaaaggagatgaggtttgtaatgcacctgacacagagttagtgctaggtaattgttagcttttattattgttactgttgttaggttgagccatgtgaaattaccacttttatgggtcaaaatggttgaatgttgtcagtattatttgtcagcctaatattatcatttaatcttgtttcctccattttacccctgaagaaaccagatagagaccaaaaagggtgacctctgcctaaggccagctcattcattgtagccatttgacagcattgatggccatcagtcctacatttgtgatgaacacggattattccttccagtcagtgataggagatatcctgtctggacctttttcaagtttatcatcaggaggctgaaaatgaatggcagaagtaattttcctctcctctttctgtcctttgggtacagcattagcatcattgggccaaactgaggtatccctgaagcatattgaagcaatggcattatgatagtttgtacattagggggcttaggaaaatgttcaaaggtcccaagttgctaaatgagataaacccttgaggtcattttcaatcttaagattggaggctcatcaagttgagagacagggatttgcagaggatttttggaaaagaaaagattagtgtaaatggcagccctccaccattttttaggcagtgtctaatagttcctcagctggcaagtagaaggaggatctagcatcagattttagatatctttcatcactaagagatgggcaagtcccattaggcaaactaatcaaaaggccaggcatccaaataggaagatgctgaagctaactccctttctttttgagaaaggaattctggagttgagaaaggtgcagtccagccaagtgaacattggtctggggagatcagttcaggactcttgccttggtttttgataaattttcaaagggaatcagattccctgcagggtggagcataacatcatacagcagctaccagtgggaatgattcaccaaagccaaaagtcacatgggagccat[136 bp omitted]accctgtctctactaaaaatacaaaagttagccaggcgtggtggtgtgcacctgtaatcccaactacttgggaggctgaggcaggagaatcgcttgaacccaggaggcagtggttgcagtgagccgagatcatgccactgcactccagcctgggcaacagagcaagactgtttaaaaaaaaaatctgatggaaggaatttaggaatttagtttcttgtgtgatacagagaggtgtacttgacttggcagttgttgataatctgggttcctactttattagtgccagtttaatattgtttaccttgaactttgaaagaaattaaaaaaaaattatttgaaaaaattttccctctactgtcccttttctatgttattattcatatgcctgaagcataaggttcggatttagatactaaggcattttttaattttttatgttattttattttgaaatggagtctgctctgtcacccaggctggagtgtagtggtacgatctcagctcactgaaacctctgcctcctaagttcaagcaattcttgtgccttagcctgccaaatagctggaactacaggtgcatgccaccacgaccagctaattttttttgtatttttagtggagacagtgttttgccatgttggccaggctggtttccaactcctgaccttaggtgatcctgacctcaggtgaccttggcctcccaaagtgctgggattacaggtgtgacccaccacgcctggccactaaggcattttttaaattaaaaattccattgtgataatttttgtgtactaaaactccgtaaccctctaactggaacaatgtccattataatatgaaaactgggattatcttcatgatgattctaatttgactgtatttgactgtacagtctaatttgacatttgactgtacattttcccctgatgtcttcaaagggcaaatatagcttccaaacaagaattgccatggatccttggataagggtggcttcttcaaagatatatgggacttgtgcttagtaaaattgtgaggttggtaaaatttgtattcgaagccttcctgccaccactaccatgatcctggaggcaggtcttcagcttcacatactcagaaacttcatttcctcagcacacatgcatctctcaggggctgattttttactttgttgtgaaaatggaatggtaatggtgaagcattctaggaagatttctgttagcataactggtgcatttcatccctgtcggcagagcctatatgggaagccaaatgttaagtaggtttcttggtgaggaatcagaaattagttgtaaaaatatacttgtctaagaatagctggaggccctactgagagtaaacagctttgccagtgggacagaaaaattcaatgcccacattcctgtatcaccctctttttcctgcctgtcaggattttgctcacagacatttctttttctgttcttccagggctgaccaactcccttttcagagtactgtcttgactggacctaagagctattctggttctataaagtgattttgtttttgtgtccttgctatgatttattcattgttgacttggtagttacttctcagaggccatccatatgtcctggttttgggggtatctcacagttgccctcatgctcagctggcagcaggcatgtgacatggcagaatagctctttagggtagcagatagaactaactgtggcaaattttcctcttcatggccgtcaacatgtagatgaaaggaaatactatctctgacttgagtcagaagctattgcaaaacaggaggtgctctccttggagctctgattaaaagcagctccattcttaattattccaactctgtcagtttgggaaatgttaatttcccggagagcccattaatcttattattctcagtcatagtaaccagactggtgatttatgtctctatgatgtctataaattggcttcctatggttccacaaagcttatctacttttcagaatgagagtgtatatactcagcacatatagcaatgtttgaaatttatacatatatatgaggtagtcaaaatagtcaaacagtagagaaagaggtttaatgaaaagtctctcttcagccctcaggccctcctcctttacttccttacccagaagtaaccatgattactggattttttttttgagacagggtctcactgcattgtccaggctagagtgcaatcttggctcactgcagcctcccgctcccaggctcaagtgatcctcccacctcagcctcatgagtagctgggactataggcatgagccaccatacctggccaatttttttttgtacagatggggttttgccattttgcccaggctggtctcgaactcctgggcttaagtgatctgcctgcctcagcctcccaaagtgctgggattataggcatgagccactgagcctggcatgattcctggattcttaaagcatccctttttaaccttaattttcctggtacagtgcatctacttctaagtgaattttgataatcatattgtttcctttaaaattgcttttagagagttgatatgttagcattgtaggtttataggtaaatttcatgtttatacctttaaaatgtgggaaattgttgtatctacaccagggtttctcaatggtgacactagtgacatttgctgaagggtttgttgtaggaggaggggggctgttgtgtgcattgtaggatgtttagcagcgtccttgacctctacttactagatgctggtaacctccccctcccaagttaggacaataaaaagtgttcgatattaccaaatgtctctgagagcggtagggagaacaaaatcagccccaattgagaatcactgatctataccatttgataacttttttgataaaaaaagcaccacatttagacatgctaatgtttcattatataagtgtgtgttagctgaagcaatgcctttttcaattttctaaccttagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtaacaactgaaagcgctatctcttggtgtttagagaataaatctgaatgctccaatgcttttgtgcattgttcattaattaattcaattctcaaacattttctgagtctaataagtgccaggcattgtactaggtgctagcagctcaatgaaaatatgagtatgtctctgccttgaagaagcttacaaacaacttgaataacaatgcctaatagttatataaaatttaataatttaaaaaatgatatacacatgcacgcgcgcgcacacacacactcacacacacacacacgcacacccctcctttagatcgagagtcacaagcttatcttgtgaagtgagtaaggcatgtattattaccctgatccattttatgaggaagaaaggaactgcgtgacttgctgtatgtcttcacatttcaggcccagtgctttaaaaataaaacacaaaatactctcttacccattatgtgtgatacttagtttgatatgcaggatatatttgggaaaagatgttgtttaaagagaaaaatattatgctggcctggctccaatacaagtctagacaagatagtacaagacaaccttaggaaaagctgtcaagtagtgaggatgatcattgttccccaatcccacctctcccaatgtccttctggctcttatgttacatacagggagtagcatatactgattaagagcagggctaccagaaaccaactgtctaactttaaatcccagctctgccagctactagctgtgtaaccttgggcaaatttcttagcccctctgcaccttagtttcctcatctgtaaactgggcatgatgatagtatctatctcctagaattattgggatgattacgtaagtcagtatatgtgaggtacttagaatagtgcctggcaaagagtgaatgttgtgtgtgtgtgtgtgtgtgtgtgtgtgtgtgtacacacacaaaaaacatatatatataacacatatatatactatatataatatatattatatacattatatgtaatatatataatattatataatatataattatatataatattatgttgtcccttggttgggtagggctgggccccatctcttaacctccagtccttagctctatgtgccctttgctctaagccattccatttacctgctttgtactgatcacaaacacatgaagtgctgtttgtaaaattataaaattcaggactgccaggagatttgaaacaacttacctgccctattctcctttccttaggagttaacgaaaaaaaaaaaaaaaaaaacggctagatgcagtggctcacacctgtaatcccagcactttgggaggccaaggtgggcgaatcacctaaggtcaggagtttgagaccagcctggtcaacatggagaaaaataataataattagccaggtgtggtgcatgcttgtagtcccagctactcaggaggctgaggcaggagaatcgcttgaacctgggaagcagaggttgcagtgagccaagatcacatgactgcactccagtctgggtgacagagcaagactctgtctcaaaaaaataataattactatactatgacataaaatggttgatgatggctcagtgtagtaccccttcaaggatcatgagggataacagatttacattttaaacagaggtgtttaatttaaagacattataccttaactaaaatggctttataaagatagagattttaggtcagaaagatactagggctcttaaagtcatgacacttaagaggcaactactaagagttaaattaggcttacctttccccagaattgcttcaggaggaatgtttgtttgtttgtttatttagagacagagtcttgttctgttgtccaggctggagtgcagtggcaagatcttggctcactgcaacctccacccccctggtttaagcaattcttgtgcctcagcctcccgagtagctgggactaaagatatgtgccaccacacctggctattttttgtatttttagtagagacagggttttgccgagttggccaggctgttcttgaactcctgacctcaaatgatccacccttgttggccttccaaagtgctgggaatacaggcgtgagccaccctgcctggctgaatgtttattttttaaaaaatgtgtcagtattgatcaaaagacagaaagttaaattgtacctcaataattttttaagacagatatatataagggttgtttgtatatccacattcatttaggaattgtgtagatattgtctatgattgaaatagtttttgatcttttatctctccctccagttaggaatattagttagggtccctcagtgatagggaagatgttttctttgtatcaggaggtaagagagaaggttgtgaacaaattagatttgagtttcctccatcctgggtgacttctgggtaaaatggggtgagagatgaagcatttgctttctgacaaagcagcatgaagcactctcatcatccccatgccaaagagtgatttgctactttgcattacaaggaaagaagggtcttaaactcttggcctggatattctaggtgatcctgagtctgctgtgactgagcttcaatgcatttggcacaacctgagctacatgaagtgttcttggctccctggaaggaataccagtcccgacactaactatactctctactattggtgagtatgtacagtacaattactggaagactgattgtaattgtgttgggagcctttggatccaacctagtcaaaaaaaaaagaactgtttaattttttctgcaaactcaacaagatggacagtttgcttcaatgaaaaatgcatctgtctttggtgtctactttttaaataaactttctatttttaaatatagatcctgtatattaccagaaaaaatgtacagagagatcccatatactccactcagtttctcccagtggtaacatcttgtgtaactatagtgcattatcaaaaccagaaaattggcattggtacaatccaaaaacctcagtcctatttcaacagttttacatgcactcgtgtgtgtgtatatgtagttgtatgcaattttatcacatgtgaagatatacaatggttgcatcaccataaggagttgctcttttatagccacactcacctccgtcttaaaccatctctccttgtacacccctctcccccaatcctctaacctctggcaaccactaatctgttctccagctctttaattttattatttcaagaatgttactgaaatggaatcctatagtatataaccacttaagactggcttaaaaaaaaaaaactcagcgtaataccctggagatctatacaagtagttgtatatcacgaggccactcctttttatagctcagtagtattccatgatatggatgtaccagttttttaaaccattcattcattaaaggatatctcagttttttccagttttttgctattatgaataaagctactgtaaatattcacatacagatttttatatgaacataacttttcatttctctggaataaatgcccaagagtgcaattgctgggtcatatagtaatggcttatttagtttttttttttaatgccaaactgttttctaaagaagttagttcaccttacatttccactagcaatgcatgagttattgatgtctacttttaaaaaggaaaatgatatgtccggggtcaaaaagttgtttgtttgtttatttatgtttttgagatagagtcttgctctgtcacccaggctagagtgcagtggtgagatctaggctcactgcaacctctgcctcctgggttcaagtgattctcctgcctcagcttcccaagcagctggaattacatgcatgcaccaccatgcctggctaatttttgtatttttggtagaaacagggtttcaacgtgttggccaggctggtctcgaactcctggcctcaagtgatctgcccatctcggcctcccaaagtgctgggattacaggtgtgagccaccacacccagcctcaaaaagtagtttagcttcctgcaaaacaactttgatattttgatatttgatactttagtatttggtatttgtgactatatctactacaaagtttgttaaatttctaagttagtcttccatcattccctttagagcctagaattattagcaacagaacaaggaagaaagaccagattaatccagtttaattcagtaaacctttatttagaacactttgtggataaaccactgaatgcacagcagagacaaaaaacatatctcttctctcctaaagctcaaaatatagaggagaagatagtgcctgatacagtgacctgcattaaattaagtaagacagtgtatgctgaaggctgttgcagagggatagatagattcctgtgggaagttaggttggagcttggggtggtggtcgaggggaggtggatgggtggatggagaggggactgagaggctttgatgaaggaggaagactgcctagatgggggagtttctctgatgctggcctctggggaagagcattttgagaaatggaggtatttaatcgttgtgatgtcagggtggagaaggggagacctagcataggcagtctgcctctacatggccttgttccctgactgtcatttgttaagacttcttctgagagaatgggatgtggagagccatgtccaagacttgtgaagctactggataaacatggcctttcatgctagagtgtctattttgcctgatgacatgatggaaagcatttttgatacattaaaacactcatggctatatcatggaatagaatgcaaaaaaaaaaaaaaaaaaagtaacacacatttttggatgaaaacctccaaagttgccccaggattcacatccgcactcctccctggtggaaggatcctcctggcaaagttgggaaatcctgcaggtggagccagaagttctgtgtggttatgtctgaggtctgtttctttttccccccctgatgtaaatctcatttgaggttttgtagtttcacctgctcactcttggtacctgttgtttctcctttacttaaaacccttcagtggctccctggtggctttaggttaaagtccaaactctccagcatgacagacaaatcgctttatgacagacctggcccctgtcaacctctccagactcggttgcatctgcctccatgcacccccgcccctcttgcagcctaccattcgcccgcagcaaacttctttcagttcctcagactgctttcttcaaatactcaaacacaacactagatttcaaacagaatattcaaacagaatagtggaaacattctgcatcctcttgtagcctaggcctttccttttcatttggatgcctcttatttgtctttatccttatttcagcccagacaccatttcctctccagaaagccttccttgacctctcaagtctagacatgtgtcccttcctcttgtctcacggcaccttgcaatttcttgtgtcatactacccagcacattgtgttgtcatttcctgttacttggtggtagcctgctacaggcttcagtttctcttgagagcgggagctgtgtcttgtttctcctggtgcctgatatatagtaggtattccataaataagttgtgaatgtttggtaggatccaaagctagagaatattcagggttgcggtgatgacttatgaggtataagcaactgaggaatattatggttcatgaataaaaagagagaaggattgagtagatccagctccctaaagaattgctaagaaggggccaaagaactaagccttactaagaaggagtagcctggctgttgatgttgtagtaaagtttagggagagctgttacacaggcttttaagatgtcttgtgagttggcagcatccatgtgtttattatgctattaacccctcttgttttccctggaatcattattggtaaaaccgcagggaaaacctttaaagaatctatgtctatataagggactggaaaagaagggaagaagtcttaaaactgtatctcattccatggcagactgggtagaaaattatcccagctattagaatcagggtggcactggaggcagatggtagcctagtccttggggttcttctaagacaaaaatagggaagtgccttggggatatactagcaaaaacaaagtctcaatgcaaattgttaaaagaatgtttcctctgggtgaatgaattacaaaaaaacctggactgaccaatttgaaaaagcattcctcttcctctgggctgaagcaggctctcaccaaagctgagagcagatggtacttgggctggctttcagccctcagttgatgtctttttgcagggaacaatctgcacagccactggaggtcgctcaagatgcaattccaagatagtggtgggtcactagcatccaagggggcagatatcaaggatcctacttttttttgcgatagggtcttgctctgttgcccaagctgaagtacagttggtgtgatcattgcccactgcggcttcaaccacccaggcccaagccatccccccatgtcagcctcctgagttgctgggatcacaggtgtgtaccaccatgcccagctaatttttgtgttttttgtagagatggggttttgctatgttgcccaggttgctctcgaactcctgggctcaagcccgtctcggcctcccaaagtgctgggattataggcatgagccaccgcacctggcctacttcttgtcatatacagtcccagagctggtcatcagcaggggatctttctgtagtgtagttctgtgccatccagtataggagccactggctacatgtggctagttacattttaatttaaatcaattaaaattgaatcaaattaaaacttcagttgcatagtctcgccaaccactttcacaagtgatgagtggctcttgtattggacagcacagatagcgaccatttccataatcccagaaagttctgttggatggtgctggtatagattctgtatcttatccccttaccaccccacagcttattctttctggagccacactgcttgggttgaaatcctggctctcttccttactttagtgtgattttgggtaagtcccttctctctcagccttagtttcataatctgtgaaatggagatagtaataatagtgcctacttcttaaggttgttgtgagggctagtgtttagagccatgactagctgctagcatatg[256 bp omitted]gcttgcagtgagccgagatcccaccactgcactccagtctgggcaacagagcaagactccatctcaaaaaaaaaatactatttattattattattattgttattatccccactcctttgcagatgcagtcagtacacagcgctggcctcttcccgtctcacagaattagtacctaacccatatctccttctttcttgctctcctctagatagatcctttctaatcaaaaccacaaaagaaagggagtcaagacacagtgctcattagcaagcaccagaaatggtttaggtaccagtataaatcacatcaaacaaactgccagagactgttttccctaacccccaaccataaaatacggagtctttcttttttttttttttcttttttttttttttggagacagagtctcattctgtcgccaggctggagtgcagtggtgcgatctcggctcactgcagcctctgcctcccgagttccagtgattctccagcctcaacctcctgagtagctgggattacaggcacgtgccaccacacctggctaatttttgtattttcagtagagacagggttttaccatgttggccaggccggtctggaactcctgacctcaagtgattcacccacctcagcctcctaaagtgctgggattacaggcgtgacccatggcgcctggcctggagtcattttttgaaatcaaaataattcattgaagccctagggcaatgacttgtgtccctgtagggacagtctggcattgaacagaccccggcctgaagagcttcagactagtcatgccagcgaattttagggattttttttttttttaccacattaatcatcttctgagttgggagaatagtctttaatttgtcaatttccttctcatatctgcagtgtgactctgcagatgaattcagtatataaattttaacaggaatcacctgctgttttaggttaatgtttcacaagaattcaagaaatgttatctattcagaaccagtattttcccttctataattatttctaaattacaacaaaattgttttaaaatttcattatctgagatccatgagcatatgcagaatactcagggtacagaaatgaaaaagggatcaagaagattgtgcattcgaggagttcctttcatcattaaaaacaattttacacatggctttctttagttatgtaagaaaaatgtcattaaatttcttcagtttctgtttttggccatgggcggaaaacattccaggacagtctgatccaaaaactagtcatgacaataacttcatttttacaacactgttttcttcataaaccacagggcgctgcaactagggggaaaagcttatgtactacctattgaaggaaaaaagcattttctatatcgaagcattcctttgtgcagcctttgaaggaataaatacattagctctgagtttttttttttttaaactgacttgcagcagaatctcctggagaattgctgttcaaatgctggttcctaggtcctggcaaaaccttctaaatcagattttctgggagagggtttgagaaacctgcattttaaagtagtacagaggattctgaggtaacaggttaaggatttgggactctttactcttagttcatttttcttaaaattgtcttccttttctgcaaaacctttgtgcaactccctttgtggctgatgatgtaagacttgactctgtcttctgccagttactacaaaacagttctctgatagcctagactaaaaaaaaaagtgtaataaacacattgtctgcctgcgctgggctaggtgctgatgatctttggggaaaggtatgtgtcgaggagaaatgggaaataaggtacctgtaatactgcttatggaagacagttaaagccacacagtggagtgagacacttagaaagccattgtgttttagaacattgacctggcagtgattggagggcactaataatgaaggtcagggaggtcaatctgaagaagcaatggagcctgtagtcattagggtatgaatctcagggtgtgggcaatggatgtatcataaaagacgaggatccatgaagctttgcaaaggaagaaagaacagaatttggtgatagaatacagggaacagaggtgggggaaaaggtgattttaatttaaattacctaatctaggagcccaaagaaaatgagctctggctgataatgggaaggttggaagaaaaaacagtttggtggagaagagggtgcatgatgtgttttggacactggatttgaggcaatggtagaacactcaaatggagcagttggagatctgggatttgttctgaggtgagatgtcaggattaggaattaccagcatagaaactgtagttgaaggatgagggagtgataaactggatgtgagtggatgagggagtcagaaagagggaagaatgtgagtagtcctcctactccccctctgctggaagagagaggagggaacagaacaagccaagaaacaaggaaggagcagggcagagggaccagaggaggaatcgtagacttcagcagataggcattttcaagaagcatgaaacttctaatcccagccttagaatgtcttctcttatacagaagaaataggcctcctgtagtctctatagctgctgacagtaccagtgttcatcaaaaaggaacaatctaggctgggtgcaggggctcacgcctgtaatcccagcagtttgggaggccgaggcgggtggatcacttgtggtcaggagttcgagaccagcctggccaacatgctgaacccgtctccactaaaaatacaaaaattagccgggcgtagtagtgtgtgcctgtaatcccagctactcaggaggcatgagattcactggaactcgggaggcggaggc[133 bp omitted]atagggtttttttaaaaaaagttatcttgcccattgcaaatattgcttttcatggacatctcagtcattaaaaagaattctgccttttttttttttttttttttttttttttttgtggaagggtcttactcggtcacccaggctggagtgcagtggtgcaatctcagttcactgcaacctctgcctcccaggttcaagagattctccttcctcagcctcctgagtaggtgggattacaagcacctgccaccacacccggctaatttttgtatttttggtagagacagggtttcaccatgttggcaaggctggtttccaactcctgacctcaagtgatccgcctgcctcagcctccaaaagtgctgggattacaggtgtgagccaccgcgcccagcctgctcttatttcttgaatactctgttgaatataatgcagaagattgtctcattttatcttgtaggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtggtaagttttagaagtcctctaaaacagtatggataaaaagtgtgttatatcttttgcacaatcaatacaaataataaaaaatgatcattctgggtttaagatcttctgaaagaagggactatattgatgtataactttctttgatagatcctttttaaagaagtaaacttggaaattctttttattgaacacatgtgccagatgctttatccttgtttagagtacactgagagttagaacagttagttgtagaaccaacattggaattgtcttagttcattttttgtttggtattttctggtattctgttgcttataacagaataccagagactgggtaatttataaagaaaaggaatttatttcttagagttctggaggcagggaagtggaaggtcaaggggccaagtctgatgagtgccttcttgtttgtggggactttctgcaaagtcccaagacagcacagggcatcacatggttagggagttgagcatgctagctcaggtctctcttcctctttgtatacatccacgagtcccactcccatgataatccattaatcggtcaatagatcaatcaattcatgaaggcagaaccctcatgacccaattatctctttaaaggtccaacctctccatactgccacattggggatgaagtttcaacatgagtttgggagaagataaacattcaaatcatagcaggaacccaggccatctgactctaaggtctagtctcttgatacttaaagaggatgatactcataatgatcatatgtagttcctaaataatctgtctcttagaaaaggcatagacttaaggtagtgtaatcgggtgatattcaaaatatttaacattctgtatggcatgggcactgatcagttagaaaaaccagtatagccttaactgtgggtgccagctgcatgtcagcctgttagaaagcaccctcagcttgaacacagattatctgattaggttctaactccttcactttgggcaaggcatataaacccccttcaaatatttccttatctgtgaaatggaatatataatctccctctatctaaaaaaattgtcataaggtccaaatgacataaagcgtattaacacattgtgtaaattactaaagcaaattccattagcgtaatggtttatttgttgaaatatcccaactgggagctcagattctggcttagatagtcatagaagtgaattctaatagggtaccaaagtcagcttactttgtaggccaagggagtgaggttggagtattttgcctagtggggtaagctgaagcagagcccttctctttgtttggcagattatcttagatgatcttttaagtcttattttgctgttttcctctctggatattaatggtgacataaaggaagaaggaagatccttctcagatagaagatgatatcttcaagttgttttctgttaattacccattatcttctattgcttggtcttaagtatagctgactcctgaaaaagtaaattgaccaggctaatgcatttttaaaaataaattatttttttctttttctgagacagggtctctgttgcccaggctggaatgcagtggcgtgatcacagctcactgcagccttgacctcccgggctcaagctatcctcccatctcagcctccctagtacctgggaccacaggcatgtgccaccacgccaggctaatttttgtattttttgtagagacggggttttgccatgtttcgcaggctggtctcaatctcctgagctcaagcgatctacccaccttggctcccaaagtattttactcttaattgtggttataaacacacaacattaaaattaccatcataaacattttaagtgtacagttcggtagtgttaagtatattcacattgttatgcagcagctctttagaactttttcatcttgcaaaaccgaactctgttcattaaacattaatttcccctcccctccgcccttagcaaccacctttctactttctgtttctatgaatttgactacttaagatacctcataggagtggattcatacaatatttgtcttttgtgactggcttattttacctagcataatttccttgaagtgcatttatgttgcagtgtgtgtcagagactaagccaatgttttaatggtggtctttgattggcattaataagtgacaactagggaagccccttgtatctggtgccttattactcatcaggtggaagtacatctggatccaagcctttctttattctctatgttgcgtctagatgtcctgattataccctggccattttctaaccagatgcaggtcagagttcatatcatctgctagataccccaaatatgttccttaaattcattttactaggcagttttaaataaacttcttctataattgtggctaaatagaaattctaaaactatgtatctgatcatgaaaggccactaaatgcatcagctctgttttgatttaactttatgaaccctgcatatatctgcagttgtctctcagtatttgtgagggattgcttccaggaacttccaaggataccaaaatccatggatgctcaagtccctgataaaaagtagcatagtacttgcatataacctatgcatattttctcacatactttaaatcatgtctacattacttataatacctaatacaatgtaaatgctatgtaaatagttgttatattatctagggaataaatgagaagaaaaaactctgtacatgttcagcacagatgctattttttaaaaaatattttcagttcatggttggttgaattcatgaatgtggaatccatggatatggagggccgactgtgtgtttgtgtgtataatcaagctttggaagcttacttgtgttctatttttgtttttcagtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtaaggttttaaaattattgtttttatttggctatttttcttttacttgaatttcttacattgaaatatcaatgaaacatagctcttacatttgtcaccttatgatgatgatggtaatgaaacttcttgtctaaaataaggcatggtggaagatttgaagatttatggtatgatagtatcagctgcaagtttcaagccatttattcatctgtaagcttcttagaaaggcctattaaacgataattcatttgctcaacacgttcttattaaatatccaccacatgccaagcactcttttgtgtgctagggataaggcagtgaacatgacacctgacaagtttttttcttcatgaaacctacataatagaaaacgtaagtaaataagcaagctaatttcagaggatgagtgctgtgaagaaaataaaatgggctgatgtagtagagtgactgggagaacgagagggaatattaggtagggaaatcatctgaggtaataacatttgagatgagaccagaatgatgagcagacgctagccatgtgaagatctgggtgtagggggtcagcagatacagactctgaggcaaaaatgagcttagcatgtgtgagagaacagaaaggagggtggtgtgaacaaaatgtagcaggaaaagatgtctaagcagtaggcagacatcagatcttgcggacactttggaggctctgataataccattctgttttcttggagtttgtggcaactaaagtaatcagatttgagtagtcaatatttgttggattatgtgcctgtatgctattcagaatcaaatgcagaacatgctaattagaggccctgtaggacactgaccagagtgtactataatctcaggacatcagtccagttgttctgctttagggtaaaggtcacaaactagggcctcacacttttttgtgtggaacacaaagtcgtgttttgtttgtttgtttgtttactagatttgaattttttgcccagattttaaatcatagtactttaagagtgtgtgtccataagatggcgccttaagaccatgaagactgcaccactcacttgtctgctacctgcctggaccctttgtgtgtttgagttttagagattagaagtgaagtgttttatattggcttttaaaggagcctagcatctcgcacgtgggtaaattccttggtccagttgttttagctcatcatggaacttccaaaatgcttgctaaaataagccagtgttgacaggctataattccaactccagagggagtgaccaagtccacagcagaacagaacagcaaatgctcttctgggcatttgcattatgaatccttctgctgaaatataataatcattactagtaccagaaattaagtgccccatgaaatgcagcaaagggaaaaatctaagggctttcatgtggaagggggctggtacttgaatttacaacaaaaggagttatcagaaagctgaaatacacttgtttactccagtctttactgttctctcctgtctgaaatcctgagatgcatgtctgaaatcctgagatagtattcattttgccactcaattattttctgctgtttaacctatcacatgtatgcattttctctccactgaaaatatagactcctacagaaaaccaaatgccacatgttctcacttataagtgggagctggacaatgagaacacatggacacatggaggtgaacaacacatactggggcctgtgggggctgtggtgggaggagggagagcatcaggaagaacaactaatggatactggccttaatacctgggtgatgggttgatctgtgcagcaaaccactatggcacacttttacctatgtcacaaacctacacaccctgcacatgtacctcagaatttaaaagttgatattttttaaaaaaagaaaatatagacttctgtaggaaggagtttggtgctgtctactttgtgcagttcctgctactaaatagcagctaacctgtattgagtgattactatgtgctaggtatcttaataagcactatatctgaattgtttcatttaatcttcacaataaccctaaggatctaggtcctgttattttgtctccattttacaagataagaaaacttagttactcctaaggtcacatttttagtaagtggtagaatcaacatttaaccaaagttgtaacgctaagacttggattcttaaccgctagagaacacctcaatacttcctcttaatagcaatagctatcattcattaagtgtttatggcatgctacaaagatgctcttctatgtgcttcttaatacagtagctcatagcaacccatgaaatagaaactattttaacctacattttattgaaaaaactaaggctcagagaggttaagtaacttgctacaagccacacagctaataagtcagtaacacttcaaaggttggttggtctccatgtatttaactttgaccaagaatacttagcataatgtcatgtgcacaatcatcatttaataaattattattgaattgagttactttttttttttttacaaacttctgaactgaagagaacacatacactatggaagttatctacctaaatcagaactattttctatttggaattaactctgtttgtacacttgagtttaatattcttcctcctagcagatgtagaatgtcatcagttttttgtgtgctcacagattttgaactctgctgcttagatttttctttttttttcctttttgaggaattattttgcctggtgttacacttaagagggggaagtaagcgggaacatgaactggtaccaacacatgggggctgtggtcagaggtagctcatgacagaattatgaagtaaggaacaacttgtctgtgaccaccccccaccccccacccccaccttcccagcagactatcttcttggtgccctggctttccttctcttagtggtctctgaagagccagtaaactatgcagggggatttacatttgaacaagagcctagagacgtaaatctacaggttgattcggcaagtttggaatttctatatatgggagatggtccaggggaggagggacatcaatttgcaacttgatccctcactggtagttgacgcttgtgattccccaacaggtctacgattctaaatggccagtaatagggtatactagccccctgagtggggttttttttttctcaacctctgtatgaaatattgaaaggatgtcccttcatcatttgcttggcctctcagctctttacacaggctggtaggaactatttagtgaatgacattgaatgtcaaaaataatatctatgtgttctggtcttggttccaagtttaaacgtctctttgatagaagttgactatttaagcaacagattttcatgtgttttttactccattttggaaatacttgcatttaaggaaattagtattctctttacattagacagcaagtgacttttattgtgtggaggagaattttgcattacactttcttttctccaacccagtcaagttttatatcttatactctcaacaagggacactggtttctcgctccctgtctctttttaaaaagtttttactgagttataatacatgaacaaaattacacaaatcataacctatagctcaatgatttttcacaaatgatttttcacctatgtaaccagcaccacagaagcccccttcagttgctgtcctcccaaagagcagctactctcctggcttctaatcccatagattgattttgttgctactttaaaactttatataaatggaattatatagaacgtacttttttttttcgagacagagtcttgctctgtcacccaggctggagtgcagtgcagtggcgcaatctcagctcactgcaacctccacctcccgggttcaagcgattctcctgtcttagcgtgcggagtagctgggattacaggcacatgccatcaagcccagctttttttttttttttgtattttttagtagagacgaggtttcgccatgttag[136 bp omitted]caacattatgtttatgagattcaccaatgttgtttcttatagctgtagatggcacgttctcactacattcattccattgtgtgaatataccatactttatccattctcccattgatggacgtttggatagtttcccatttggttttatgaatggagttcttatgaacgttcacatacttgtctcttggtacacatgtgcgtacatttgtatggggcatttatataggcatatgtgggtcataaggttacatatgattgtctctagtagataataacagttttcctggatggttgtgccagtttacactactaagcagaaattgtgagttctagatgcttcatatcctcacaacacttgttgttgtcaggtaagtgtgtgtattgttatcttgtggatttaatttgcatttttctcatgaccagtgatgttgaacactttttcagatgtttattcgcaacttgcttatcctcttatgaagtgcctgttcaagtcttttgccagtttttttaaaattgggttttctgtttttgccttattagtagggtaagaaaaaatacatatgcaagtcctttgtcagaaattgcaaatatgttctcacactctatgcattgcctgtttatttccctataaggtgtcatttgatcaacaaatgtttttaattttaatatggatgactttattaaaaaattctctttatggttaatatgggaggtttttttggtcttgtttaagaaatatttcccttcttcaaggtcattaagatattctctgtttttatctaaaagcttgctatagttatgtatttattaattcattttatcttacacatttaaatctgcaatatatcaggaactgattttgtgaatagtatgaggtagggcgtcaagaatctttttttttttcatatgcatatgtaattgacccagcaccatttattaaaaaaggccaaccttttttcactgtacctgatcatcttttaatgggataaaaggaaagcttgttagaaatgactaggtgatagaaaatgggtttttaaacatttaggactcattagtttatttatttatttttattttcaaggtccaagaggctaaatgtgagaatccagaatttgagagaaatgtggaggtcagtaaattcaacattagctatttgggtttagacttagagcagttgggggtggagcatagcctaaatatgagctgctttgagaaaaacaaattacgttgttccgtgagttattgacaattttttcgaaaagtcaaagataatttgaattgcaatccaagtcttaatcatagacagaatttggcagataattgtattatgattcaataacagtgaaaaagaataaactggtaatattccttgtgtatttttattttatgcctaagaatacatcttgtttcatggtccctggtgttcttcctgatactttgaacacagtcagaataagagtcaaaacaaataagttatgctatgaggatgacaaactctggagtaattggagccaagaaatgagtataggtaagagaacagaatttttattaaaatttaaaacactgatgtataaaaactaagctgaagcagaaaatagactggggaaagggactgtcatgctctcttgatgtcaggaaaagagtacttacaattgaaatttattttcttcttaatcactttcaaaccacccagggttaattgacagtatacagttatttagaaaaccataatccaaatggttttatgttcttttctatctcatttccatttttattaacaaactgaacaaaaatatagaaagcaggcataggctgcacacagtgactcacgcctgtgatcccagcactttgagaggctgaggcaggaggatcgcttgagcccaggagttggagaccagcctgagcaacatggtgaaaccccatctctacaaaaaatacaaaaattaaccagatatggtggtgcacgcttgtggtcttggctacccaagaggcagagatgggaagatctcttgagcctgggaggcggaggttacagtgagctgagattgtgccactgccctccagcctgggcgacagagtgagaccgtctcaaggaagaagaaaaaaaaaaggcaggcataataaaatttgcacattgtacaatactagagactgtcctacatgctggttggcagaaacaagagtggagccatttaatagaaacctgtacctaagtttgaaaaaaatcatttattaattgaaaggctgagcaagctaggctcaagtacaggactggaaagacctgtgctttatggatgtgtgtgtggtggggtgggatacacggctttataagtgcaatgtgactcaacattgtaatcttaaatgtgtcaaaaaggcatatacaatcttaggagtgataagtgcagcacccagaaaggaatgctgcaggttggggcacagagctatggtcacatcagaattgtgcagtattccattctgagcaccacattaaaggagttgccttggcagactggaatctatccttgaaaggataatcaggatgttgaagaatctcaaaacttggcaaggaacaattggtaaagtaactttgaggagtcatgattgctgatttctaatatttgaggtattgtcaggtacaagaaggaataggctttactttttgtgtctccaaggggcaacacagaaccaacttaagaactttttaaacagctgtatattggtcaaacaggttgtcgaggtagccaattccctattaattgagaagctcaacaagttatgtgccaggcatggttgtattcgtttatttattgttgtataacaaattactccaaagtttaatggcttgaaccaacatacatttaccatctcacagtttcggtgagtcaggagtctagccacggcttagctggaggtctcatgaggttgcagtcaagctgcaatgagaactgaaatatgtctgaaggcttgactggggacagagcatccatttccaagttcactcatatagttgttggaaagcctcagtacctcactggttgctggatggaggctgttgcaggttgaattgtatctcccaaaaaggtatgttcgtaggttccaaccccggtacctgtgaatgtaaccttatttggaaataggatttttgcagatataatcaagtgaggatgaggtcatgctggattaaagtggacagttaatctaatgactagtatccttataaaaagagaagccacacagagacacacagacacacagggaagaaagccatgtgaagatggaggcagagattgcagagatgcagctacaaccaaggaacaacaaggattcccaggagctaccagaagctaggaagaggcaaagagggattcttctctagagccctcagagggagcatagccctgctgacaccttcattttggatttctagcctccaaaactgtgagataatacatttctgttgttgtaagccattcagtttgtggtaatttgcttcccttagttccttgccacttggacctccccatagggctacttcctgacatggaaactggctttcccaagtgagtaatccaagcaagaaacagtgtgagagaacacgcaatatgggaaccatggtcttttataacctaaccttagaaatgacatcccattactgctgctgttctgttttttagaagtgagtcaattagtctagcccatgctcaaggagaggggattacaccagggaatgaatatcaggaggcaggaatcatgtggagaaatcttagtgactgcctaaaacaatggtgccaggccttgatgatgctttctagatgttcatgacctagtgggaaaaatgaatttgtatatagacaaatgacagtctatatgttagatgtagcaaggcaggctttggaattggacagtggaactggaatttgaggcctgatgccattatttactaaatccttccggatgacttactaaacctctctgagccttatctttctcatctgcttaaatgggagataatgctatcattatagcatatatatgagataagcatgcaaaaccacctagtgtggtatcagacatatagtaggtgcttatttaagaataatagtagttgttaggattattttaggtattttagtagtggtaagtaaccagtaaaatatgtagtcactgttaataagattacatatttaatatagcatctttgttaatagtatttaaaactagttaagatcttctgatttacctgagcgggtggggaaacccaccccatgagcatcccctgggctcacccagtgcacagagggaggcctcccgtggctgggcccctctcagtcagcccatgtggctgccatgacctggagcaccacagccgggggcgcccaccagctcaacaccaccacattcacgtggcagcacctccctgcctggcaaccgctgctgttggccagcattaggctgcagctcttcttctacgtgggcctggccttcatcagcctggacctctattactcctccaccagcatcaaggagctggagtacaactacaccggcgacccgggcaccagcaactgctcggtgtgtgctgtggctggccagggctgtgtgccactgcccatctgctcatgcgcctggtacttctcactgcctgagctcttccagggccctgtgtacccctactacgtgctgaccaacttctaccaaaacaaccggcggtatggagtgtccgcgacaacgcgcagctgagcgggctgcccagcacgctgcaccatccagtcaatgagtgcacccactgcgccgcctgcccatcgtgcaccctgcaatgtcatcaccaacagcctcttcaacgactcctcgctgtggcaccagtgctggcccggcgagccctacgtggaggtgccgcgctaccgcactgcacctgcatcacccggtagaccaactaccccatcaagttctgcaacccaccactggtcaacggcagcctggcactggccttccatggcacagcacccctgcccaactggcgctggctggtctacgacaagctcagccccatccccaacaacaacggcttcatcaaccaggacttcgtggtgtggatgcgcatggcagcgctgcccacgttccgcaagctgttccgcaagctgtacgggcacatccgccagggcaactactcagctgggctgccgcggtgtgtctactgtgtcaacatcacctacaactacctggtgcgtgcatttggcggccacaggctccgcatcttcagcagcatcttgtggatgggtggcaggaaccccttcctgtgcatcgcctatgtggtggtcagctccctctgcatccttactggctttgtcatgctggtcatctacattagctaccaggacctaccagaaagatgatgacaatgaggaggaggggtgattccagctttccaacgacccttcctgcttcttaccaaaattctgcaagcttttttcagtctctcccctttgcctctcatcctattccaacctctcctcacttttcctccctttgtgaatgagggggccagagaagggaattacccacttactcttgggggctgctaaactctgttgcctggtggcggagggttgactgcagagtgaaacatccttgcaaactctccccacctccttcatgatgctgagatgccatgttaggttctccaagtccaagagtggaagggatccttatagagactcattttcaacccctaccagaggaagagattgagagacctagcaacatcaaataactcaatcaagatcaggcagctggcaagtggttcctgacgctaaggctagagcttttgccactacagtacagtggttttcttttctttgtggggagggtgggttgggatggagagtgagacccacaaattatctgcagaggcatggaggggtgtgggagaacatatttgttaaatatgcagatagatgaggaggcaccaaccccagagattctgacacagtaatgctggggtgagatgcttgaaactgtgttttaacaaactcctctggagattcctgtattctctcaaatttggaaatcactaccctgaacctggttgggcctgaagcagtcacctgagtccagtttttcagatagtaatttgttcccagggacagtgacaccataatgttgcaggtttggtctggcactctgccttaaatatagtatgctctaatgacttgtggaatgaatttttaaaaaatcactatctctgggctgggcgccatggctcatgcctataatcccatcactttgggaggctgaggcgggtggatcacttgaggtcaggagtacaagaccactctggccaacatggtgaaaccctctctctactgaaatataaaaataagctgggcatggtggcagatgcctgtagttctagctcccgggaggctgaggcaggagaatcgcttgaacccgggaggcggaggttgcattgagtcgagatcgtgccactgcactccagcctgggtgacagagtgagactctgtctcaaaaaaattaaattaaaaaaaatcactatctctggaaaactagttggtgtacagatttgtaggccagggtttgtgtcgatttatttgatattttagtataacagcaaacaggcaaactttaccagatactgtgtagaaatttgaaaatgtgaggccagtttgtacagttcagagggaatgctttttaactgtagaatcagatagctggaagggatctttgagggaaagtaatttccctagtcacatctatgtctcctggctcagtcttctttgtcatttaatctgtgtgtgtgggtgtgtgcgtgcgcacacgtgcgtacttacaaagggcttcattcataccttttctcttggatctggaaaaaatttttttatgttttccaatgagatacatttgtagtaatcatatttgaaacaatgctaaggtatatatagtcttatatgtaaactagaatcttaacattatttgaatcttggagataatgttaaaagtcttagctaaaatgattccattgattttatcgattgactaacatcaatcaatatgtttaaagttattctaagaagcaatatttttatttaaaaaaacctttctttcatggcaaaatagcttaaaagaactttaaaaaaaaaccctatgtgatatgttccagtttatttgctaaaagcaaacagttatttggtatttgtcagacagaattcttcagtacctgctttctattatagctattttccagttaccactcattcgtttatactccttcctttaaagcagcacaagatcttgaagttttttttttatcagttaagaaatattggattgtattggatagtatacatagtttagtctgttagttctctgaaagttactgaacaatggacaatgtgcatgtcactgacatccgtctcagatcttctgggacaactatgatttaagagattctatctcattattacagataccaaaaaaatacttgggtaattccagtgtgttggctttccaactcctgaacactacacaattttattatcagtttttgtatggtgattttaggctatgaaaacattattttatgtacatagagaaatttttattatgaatgtttgagctcactagcccagccctcctctattttgaaaaagagagtttactacattttttactatgtagttgaaaacaacatgtattttgtcatttttagaatggtcagtctatttctataaaattttaaatgtggctgggcgcagtggctcatgcctgtaatcccagcaatttgtgaggctgaggcggacagaacacttgaggtcaagagtttaagaccagcctggcccaaatagggaaaccccgtctctactaaaaatacaaaaattaactcggtgtggtggtgtgcgcctgtagtcccagctactcaggaggctgaggcaggagaatctcttgaaacatggaggcggaggttgcagtgagccaagatcgtgctattgcactccagcctgggtgacagagtgagagactctgtctcaaaacaaacaaacaaacaaaagtttaaatgagaccatcaaatttaagggattctgatccagattaaattaatgaatatggttccaggtcctagtctctgagtttttgaaagagaataaagcttatgtttgtcttttaaaaaatatcctaatttcaggtaatcttttaggtatttgctcgcctagggaagttcaggcaccagaggaggactttttttttttaaactattaatttaacagaagataagataattgaagagcttgggaaaataggttgggggagggagcagaaatatttgtgatcttactagctaacagaattgctgcttggtttattactaaaagggttttatttctcaagtctttctgtttgcttttcattctccaggtaagaagcgcaattccacactctacataaccatgttactcattgttccagtcatcgtcgcaggtgcaatcatagtactcctgctttacctaaaaaggtaaggtagctgcccaggcaggttttgcagtttctgatagcctgtttgctgtggttattacttttagtgcttgtgttttatgtctgcccagtgtattagaagcatgttgcctgtaagtggctttcgggagtatgacatgacaaggaagtattaccacgcccactttcttttcttttcttttttttttttttttcctgagatggagtctctgttgcccaggctggagcgcagtggtgtgatctcggctcactgcagcctccacctcctgggttcaagcaattctcctgcctcagcctcccgagtagctgcgattacaggtgcccaccaccacgcccggctaattttttgtatttttagtagacagggtttcaccatgttggccaggctcgtctcaaactcctgacctcaagtgatccaccctcctcagcctcccaaagtgctgggattataggcatgagccactgcacccagccgctatgcccactttctaatgaaaaccatgttggattagttttccagggctccctgctcaagcactgctgcctttgcatgtgtttaggattgttgaataggtcctatgttcacataatactctttcaaatgcctaatctatcaagttagtcagtagttcttagaatgaagttttagaaatggagacctttactaataaaatgacttgtctggtattaatgcaaagtaggctactacttaatattgtgggaaagagaacttcatcaagttgtcatgaatgtatggtatccattccttgagaatattttattttctctatctcattataggactgttatttgctcttgtagtaaataactaaggttgaaataaggttattaagttggatccagaaccaatattttatcattatttcaacatttattcaacatatatatatactctctctatatatgtatattttttgagtgcctatttgtgaaccaggtactgttctaagtgctaaagttacagcagtgaacaggacaaagtcctcatctacattctagagggaaagatacacacatgcacatacacacacacacacaaaataaataataaatactataatttcacttagaagtataattgacagtagtggggtatggctaggaggtgataggaggtgcattttatgtaggatgtcaccaagaaagtgacatttgaggagagactcccagtaatgtaaaggagtgaatcattcagatattcgaggaaagagcactccaggccatgggaacagcaaatgcaaagtccccaaggctgaaatgcacttggtttgtttggctggagtggagagtgcagggtagagagtggcagcgagggaggacagaggttggccaaccacatcacgcaggccatggcaaggaactgagattttattctaagcatgatgaggagcattggagagttttgagcagagtaggcacatggtctgagttactgtcataaaggattattgtagttgctgagtgaagaactgacttgggcaaaagtggaagccgatggagtagttcggaggcattgcagtgttttggcagaaagatgaggataacctatactagggggttagcaatggagatagcaagaagtggtcagaaatagtatatattttgagagtagaattgataagacttgctgttagttgcctgtctgtggaggtgtgaaggtaattaaggattcagagatacctcttagatttttggcttgagcaactgagtgaatgctggtgccatgtactgagacagagaaggctgtgaggagagctgggtttgagggaaagataaggacttcagttttgcatatgttaagtttgagatgcttattagatatccaaataaggatgttaaataagcgattttgtgcatgaatctggagttgaagggagaggtctgggctgaagatctaattttgggaatcctcggcatgtgaatggatttaaagcctaaagaccgaaaggagtgctcataaagtgaatgagatagacaagaagacaaaaaactgaatcctggggcacatccatggacactcactgggagatggaggcaagctataagattgaaaaatggagagaagtaggaaggaaaaagaaacagaggaatgtatcctgttctcagattattcttttcaaaattatacagagcaagcgcccatctggtctgttaaaagtagagtagcatattatttagatgatagggtataagtaattcatttattctgatggtccctgtgctccacctatgggcaagagtagaacttaatgcccttagaacattgatttttgtgtaccctattttagaaatttcttcacaactgccttgtcaataaagatgacttgtgtaccatgtcttttgtccatgccttcttttaatatggtggtatttatgtgggacactcctatggactggaaggtttgaatcaaatgtctctgttttcttaaaggctcaagattattatattccctccaattcctgatcctggcaagatttttaaagaaatgtttggagaccagaatgatgatactctggtaagaacagatttcatggggcttgaaatgtttttttttttttttttttttggaagctatggcattttttaaaaaagtgtggtaaggtatccataacataaaatttattattttaagcatttttaagtatacagttcaggctgggtatggcagctgacgcctgtaatcccaacactttgggaggctgaggcaggaggatcacttgagcccagcagtttgagaccagcctggacagcatgccactgcacccagctaatttttatatttttttgcgagatctcatttccacaaaatatataaaaattagccgggtgcagcggcatgcacctgtggtcccagctactcaggagattgaggtgggaggatcccttgagcccaggagttcaaggttgcagtgagccatgatcatgccactgcattccagcctggatgacagagcgagactctctaaaaaataaaatatatatgtgtgtatatgtgtgtgtgtatatatatatatatatatatatacacacatacagtttagtgtcattaaatacatttataagttgtacaaccatcgccactatctctttccagaaatttttcatcatcccaaatagaaactgtggctgttaaacaataattccccatcccctcattcctcccacccctggtagcctctattctacttcttgtctctatgaattaaatattctagatacctcctatatgtgaaatcatgcaataatttgtccttttgtgtctggcttatttcatttaccataatgttttaaaggttcattcatgttgtagcatgtatcagaatttccttttgaaattggttcttctaaagtacaatttatttttaaaaatttgaaggagagctgatttaaaatatagtatctgaggccaagcataccagttaaaaagtcttcagaatactttgctcatcttatataactgggctccattctctctctggttaggagacatattttatcaaaacatgcaggaagaagggcctcctttatgaagctagcctaatgagcaggccttctgactcttggataatttaaaaaacttgatgtggggaaatataaacatagggtaagcaattgaaatgcattgtgttcatgttgtttcttggaaggctagactccaaagatatagaaatggagcagccctaccccaactgttatagttggtttcctgcagattctcatgctagaatttgtggccagaaaacctaagacattatgggaacaaaagggtttgaggcttctaactttagttggatttatcatccaccctactgaaataataaagacactaaatgaaataaatattattatcattgtgtatatcttaaaggaataataacaagcatagggcagttaatttagggaagtagtactgcatagtagataatagcctgatttctggagtcagattgtctggattcatatccctgctgtgtcatttaccatctttttgaccttggataattttcttagcttctctgtgactcaattttttcattagtaaaatggaggtaacaatagcacctgcctcatagtgttgttatgtggattaacttaatacccaacagttaattgaatggaaactgcttagcctacctggtaccttgtaagtgcttaataagtgttagtgattagtattactattgataataatttatttttatctttaattcccaaataattattgtaataatgggtgattctcaatggtagtgatgatatttggttagggaaggaaggcagagaggcaaatatgctatcagaagaggattcatttggatcactttttaaccaggtcatcttcacagacagtagataactctgccagaccctgggagtcagggcatgtagacccagaagttaggtacctgatgaggaaattgtatgccgtatctggagcgagtatgatagctatggttctccaactttagttgagtcacagtcaactggagtgcttacaagaaatacagatttctggaccctacttccaattccctgacctgacctgatttggcaggtcagggacgagttctaggactctgcatatttaataggagcccacagatgatccctgtcctgctaagagagtctgtggaccacactttgaaaatcagtgataaagatatttacccctgtctcttacttcatttcaccagctgtgatagatgctggaggttgggaattgtacaagtaccctaacaactttcaccagctattgaaagtctactatgtgtcagacaatgtattaagtgctttgcctatattaccttattgaatcttcataaccaccctatggagaagatgctgttggtattattttacagatgaggaaatggagccccaatgaggttaagcaatttagctgcagtcacacagctagttggtggtaaggtagaatttgacccagggctgtcttaatgctagacttctcttggtctttctactaggctgcattgcctcttgtaagatagaatgcttgttctgaagaacctcaccatcttctaagacatctgtatgacagaagtagagggttggcataggggatttctgagaaaaagatttagggttgtattatgaatagctttaaatgggaagatattggcatgtcttgtatatattaatggcacttttcatgcactgctggtgggcctgtaaaatgatagatatcctttctggagggcaaactggtaaaatgtaacaggaatctttgagcctatgattatacttttaggaaccaattttgaggaaatgatccaacaatggcacaagagtggtcaatgcggcatttgcttttaacatgaaaaattagaagccaatgaaacataacaattgagaattagtttaaaaaaatatgttaggttttcaaagcatttaatgttataacaaaatactcaaaatacaggagtaagaaacttaccataaacatgtagtatattacaatcataatttttatcaaaaatgcattaatatatacatagaacgaggggaaggaaatgggtccgaatgaatgatcatttctaggcaaagggattgtgggtaactgatattactctctctctacctttctaaaatttccagattgcctatagtgagcatgtactacttttataataaaagaaaccctgtacaagtcattaagggaaaaagaaaatactgtagtcatccaggtctgagagataataggaacttgaacttaggtggtagcagaggagattgacgtaagagacattattaaaggaaatcaactcattatgacttggtgagtctgtgtgggtgatgagaggtagggagagtaaaaaataatttcaagttttcaagtctgagtaatagagtgaatgatggtaacattgacagcaaaatcagatcaattatctttctcagagatgggaaaattgcttttttcaatttgctgtctagaggataatatgttgtttttgtcccgatgagtcagataattctgtaatttggtgacgcaaatatactgacaatatggaccattaaaagcacaaggtatttttgttttgtccattgcagaccattaaacaaaatcagttctttaaaactaaaagtataataaaaattccagatatggggaagggtaagagaacaaatttttatgtcggcttttaaccaaatgaaaaaaatctgctttcttcacatggcatcaattctcacaaattgaactgcatatgctgcatactcttttacttctagcatcattgaattattgaatgaacatagccctagaggtcatctaatgaggtggatgttgacatgtttaattatttccctttaattataaatgttcaaaactcgagattctcactcatctccctctctttagagatggggacatgaggagccacagagaagtttctcaaggactgtcactgtgttaagccaatcttgtattgctataaagacatacctgaaactgggtaatttataaataaaagaggtttaattagctcatggttctgcaggcttcacaggaactgtggtgccagcatctgcttctggtgagtatctcaggaagcttacagtcatggtggaaagtgaagggggagcaggcatcttacgtggtgagagtgggaacaagagggggtaggaggtgccatacacttttaaacagctcttatgagaactcactgttgtgatgacagcattaagccatgagggatccacccctatgacccaaacacttcccaccaggccacacttccaacgttggggattacaattcagtatgaaatttggcagggacatatatccaaactgtcagtcacatagagaggcaactgcaaaacctggactagaacccatatagcccaaagttaccaacttccaatccaaataaataatcttgtccttttttaaacactgtcttcttccacactgcaccattaatagttgttcttataaaaacttatttagttatggccatgaataagttaaatcttcagtatagttttccttaaagttactcgtgttttgatgatgttttgttcattactatagtaatgttttggccaacagcatttctttctgttgctttgctatttgccttttccttgtgactaattgggcttctggccatattgaggggaggtaaggggagttgcagagggaattgcttctcctctctatctgcatttctcttatccataaaaaaaaaatctgtcctccccctgcttcttggaaaccaattcttattttcagcattgtgccatttttatattcttgttcagaaaggagctttttaaacatggggataacatccaaatactgctgattgttattttttacttcagtgtgtatcttttttttttcctttttgagatggagtctcattctatcactcaggctggagtgcagtggcacgatcttggctcactgcaaactttgcctcccaggttcaagtgattctcctgcctcagcctcccgagtagctgggactacagatggtgccaccatgcctggctaatttttgtaattttagtagaaatggggttttgccat[138 bp omitted]agccaaaatagcattactgtactttaaaaattattaattccttaatttcatctaatactcagtccatattcaagtatttccaactgcccaaattgtcaggagacagatattatccagtcatctcaccactgaccactaagacagtggttgagattgaccactatatttaaggtgatacaacagcatgtcccctcctgccatctgcacttatttccccattgcttcaacacagataatctgtgtagtgttatgctagcaccttgtcaagtcttcagctaatgctttttacatcagttgatatccttgcttgaatcagtaatttccttaggggttgggttgaatattacagtttttctctttctatcatttctacatttacttttcttttttttttcttttgagacaggatcttgctctgtcaccgaggctggagggcagtgatgcaacctctgctcactgtagcctcgacctcctgagctcaagcagttttcctgcctcagcctcctgaatagctgggactatagtcacgtgccaccacactcagctaatttttaaatttcttttgtagagacaaggtctcactatgttgcccaggctggtcttgaatttctaggctcaagcgatcctcttgcctcagcctcccaaagtgctgggactacaggcatgagtcaccgtgcctggcccatttctacacttattagctgacaggtatctataaagcgctgctttcagtcatcaactgagctctttagttgttctgaaattcagttcctactaaaaaggcaagatgcatatttaatcatttccctttatttatccattaaggtgaggagttggattaatagacacctcatagtaccaagttattcctctccataccaccacattcaacttggtgtttttttgtttttgctttttttttttgagacagcgtctcactgtgttgcccaggctggaatatagtggtgcaaacatggttcactgcagcctcaacctcctgggctgaggcaatcttctgatctcagcctcccaagtagctgggaatacaggtgtgcactaccacgcccagctaataatttttttttttttttgtatgaatgggcttttgccatgttgcccaggctagtctcaaactcctgggctcaaatgatctgcctgccttggcctcccaaagtgctgggattacaggcatgagctaccgtgctgagcctcaacttgttctttttcaagttgcaatgattttaaggtgtggagatctacaattcattttgtataactttctgttttgaatgataatctgaagagagactggggcatgaaataggtagacttgtataccaaaggccagtgtttttgcatggggctaaggtacatgaagctcacttcacttctgtagacaatccactctggaaaatatcttaaccaaatcttgaaagtaatcttaagttgagacttgatatttcattgtactaccaaatttatgcctttaaattataaaaacctatataacatgccgtttttctaggctcacataattaccaactaaaagccagttgtgtaagccccctaatcactgattttcttcatctatgatgtttttcatctttggccattactctgttgttgattactttgtttttaaaattggcagtaaggattgaattttgggctggtaattgtgtggatttgtttatttttttctacaagtggttttaaaattagacaggcatataattcacagaattgaataataggaaagagccattgcatttatttcttttaccttacatggacatattcatagaagcagtactcaggaaaaggccactgtgttgataaagggtggaaatgagagtaattcaaattttggggatgaaaaaaggcaatcagaaagattaatgtattctgagaagccctttctgttgtagtgttcacctcattaaaacaaattgcttttttcttgtccagcacagccaagtgttggtctaatgaccggaaacaaaagtaattttcagggtgcatttttaatagttatacagtttttatttgtgaaaaatccatattacacacacacacacacacacttcaccactatacattcatgcattttttaaattaaaactttttttttttttctgatcacttgggaggatgaggcaagcggatcacctgaggtcaggagttcgagaccaacctggccaacatggtgaaaccccgtctactaaaaatacaaaattgaccaggcatggtgatgcatgcctgtaatcccagctacttgggaggctgaggcaggagaatcgcttaagcctgggaggcggaggttgtaatgagccgagattgagccactgcactccagcctgggcaacaaaaatgagactctgtcgccaaaaaaaaaaaaaatatatatatatatatatacgtatatatgtatatatatgtatatatatatatatatacgtatatacacatatatacgtatatatattcttttaaaagcaatatacatttagtatagacaaattagaactacagatagtcaagagagaaagacaaaatcactcttaatcctgtcacccagatataactatctttaatggtatgtgaacaacatagggaaactgaaatacctttagtgataaatggagtaatagcaaccacaataataatagttcatacttatggaacctttactatgtgtcttaataacactgtcatattgaattgtatttgaatgtaacaaatgagaattaaaagaatttctgaacttttgatataaaataaattttaatgatgattgaaaagatatttttccatatgctctccccatttgctccccatttttatagttgttgaacatctccattgtgtcctcatatagagccctcatttagtcttacttcagtgtgtggagatacacttgatgctcactaccattttttatgtcaacattgctccagtcatttgggttgtttgaagctggaaagttttctcaggaagtattcatgggaccggcatttcctgaattatttacaaattgatggaatttgctacatttatcattgaaagtcattttggcaaaatataaaatccatggctcataggtcctgcgttgcgtatcttaaatgtgtcatccattttcttctggcataatatgttttgtcagagtcagcagacaatataattttcctcctgtattaaaacacttggtctttttggctggttgtcaaatgatttttttcttcaaagtccaataattttaccagaatatgtgttggcgttgtgattttttgcagtgtatggtgtgctttctcagtatgtaattttagatctttttttttttaattttagtaaaagtttcttcacttacagattttagttattctcttcccatgttttctttgacctttcacatcttttttgttttggcacagggtcttgctctgttggctgggctggagtatggtggcaccatgatagcttattgcagactccaacatctgggctcaagtgatcctcccaactcagcctcctgaatagctgggacaggcatgtgccaccatgcctggctaatttttaaattttttttagagatgcagtcttgctgtgttgcccagtctggtcttgaactactggcttcaagttattcccccacctggaacttccagagttcaggaattataggtgtgagccgctgcacccagcccttccagccctttcacatcctcttgaataattttcatccaccttcatttcatttttgttaaaaaatcctactttttaatctatttaagatcttatctgatgatatgttgtgtttatttgccctgtgtttcttctagcttagtcttcaattttgaaatgattattttcctttacttttattttgttttattttttgagatggagtctcactccatcgcccaggctggagtgcagtggtgcgatcttggctcactgcaaactccgcctcccaggttcaagtgattctcctgcctcagcctcccaagtagctgggattacaggcacatgccaccatgcctggctaattttgtattgttattagagatggggttgcaccatgttggccaggctggtctcgaacccctgacctcaagtgatccacccaccttgacctcccaaagtgctgggattacaagcatgagccactgcgcccagccttcttttacttttaattcttctgtgagttttgtcatccaatttctgagttgtttatattgacttttaatatattcttctacattgattactttttttatatcatgtaactttttaaatatacttcagctagttttgaaatattaggttgtagttttcatctattttgtggatatatcgttctgttatgttttaattctgtaagagtattattctgtggctcatttttattttattctttaattttaaacattttttattttaaaaataattgtcactttgggaggctgagg[131 bp omitted]gaggcaaggagaatcgcttgaacctggaggcagaagttgcagtgagccaagatcacgcctctgcactccagcccgggcaacagtgtgagactccatctcaaaaaaaaaaaaaattattatttttgtagaggtggggtttcaccatattgcccaggctggtctcaaattcctgggctcaagcaatcctcctgccttggcctcccaaagtgctgggattataggcgtgaacaaccacacttggcttctgttgttcatttttgtatgaaatcagtttcctgaacttttagaaggaggcttgattgagacaagttgtttctttccctaattttatggctgtagagctccatcctctaatgaattacattctgaaatctcctggccctttctgtctacctttctgctttgatctaggctttcttttttgtcgctcttgtccctgtcctgactaatttgtaatccagtttcaccagtttctcctcagagtgcagctttgccctggaagggattaaggattagttttgagtttctggaggcccaggctgctttcagtctagaccacggactccttgcactcaatcactgtttgaaaatgcaaacccttccctttatcagttgttcataaatttgcttgctgaagttgagttattttacagttctcagatctataggatgccatgttgagtccgtttatatactcttccacagcttataccattttggtcctgtaactatctctaatttgtccacattcactcttactttgaggttcatgggggaaatgttttcatcttgttttgttgtagatttcatcttgtgttggtagattttggatttactttcctattgggggaaccagcccccaatatttcaacgtaagttcttttctattttccctaagtgtcagccggtctgataaataaagggaaagagtacaaaagagagaaattttaaagctggatgtctgggggagacatcacatgtcagcaggttccatgatgccccctaagccgtaaaaccagcaagtttttattagcaattttcaaaggggagggagtgtacgaatagggtgtgggtcacagagatcacatgcttcaagggcaacaaaatatcacaaggcaaatgggcagggcaaggtcacaaggccagggcgaaactagaatttcgcctggttcctggtcctgctgtgcatgcattgtcattgataaacatcaggaaacagggtttgagagcagacaaccattctgactaaaatttactaggcagaaatttcctaatcctaataagcctgagggtgctgcaggagactagggcgtgtttcatctctatctatgactgcataaggcagacactcctagagcagccattttagaggcctcctcctgggaatgcattcttttcccagggctgttaattgctaatattccttactggggaaataattcagtgatatttctcgtacctgtttttggcaataagagaaatatgactgtcctgcccggctccaggcagtcagacctaatggttatctcccttgttccctgaacattgctgttatccttttcttttttcaaggtgcccagatttcatattgttcaaacacacatgctttatgaacaatttgtgcagttaatgcaatcatcacaggggcctgaggcgacatacatcctcagtttatgaagatgacgggattaagagattaaagtaaagataggcataggaagttataagagtattgattggggaagtgataaatgtctatgaaatcttcacaatttatgttcagagattgcagtaaagagaggcgtaagaaattataaaagtattaatttggagaactaataaatgtccatgaaatcttcacaatttatattcttctgtcatgacttcagcaggtccctccgttcggggtccctgacttcacgcaacactttcctatttatatttccaacttgtgtttttttatggtgatatttgggaatattcaaaaacgatgctgctaccaccatcttcttcgcagaatttttctgcaaactatagaccaaggggcaaattctgcctgccacttgtttttgtacagtctttaacctaagaatggtttttgtgcttctaaatagttgggaaaaaaatgtaagaatactatttcatggcacatgaaattaagatttcagtgtcatacagtttcgttggccaggcccattcatttatatattgtctgtggctgctttcatgctacaacagcagagttgttttataggcacagagactatatggcccccgaagctgaaaatacttcttatctagccattttcaggaaaagttagtcaaccctggtcccctataatatagtttttagtggctaaataatattccattgtgtgcacatattataatgtacttaacaaaattcctattggcatttggatgaatcctaaatttcattgtataggcatcatttcacagctaagtataagcatatgtattaatattttattactgtcttaggataaattgttacaagccaaattgcatgatcaagggggagggtatatgtattttaaactctttgactgatacaggctgagtattcctaatctgaaaatctaaaatccgaaatgctcccaaatctgaaactttctaacatgacgttcaaaggaaatgttcattgcaacatttggaatttcagatttttgcgttagtgatgctcagctggtaagtatatagtgcaaatattccaaaagctgaaacacttctggtcccaagcattttgcataagggatattctacctgtattgacaaattgtcatccagaaaggttgtacaaattaaattcccattaaggaaactggctaaataagttatggtgcattcatgcaatgaaatattatgtagaggttaaaatgaggtagatcacttttactgatgtataaaaatataacatacactgttaggtgaaacacccaggttacatatggagagtatgattcctttgtgttaaggaaactggggcattaaaatgcacaaacaaattttttcataagaagcatagattacaactaagttgtgccagttcatatacctaccagcagtatgttcgactggttgtttgaccatacttttgccaatatgatattacctaattttaaaattcttgccaagttaatagatgagaaaagagcgtcttaattttacagtcaggttttgtactttttcccaagtttattggcttgaattaattcttttgtgaaattcttgttccacgtccatttttccttgttgtattcatcttttggtggtttgtaaagctctttacgtattagatattaaccctctggcttcttatccatgttttcctttgtattgtatttagggtgattaatgatgtacaaaaggtttttccttttttatgcagtcaaatcttcctgtatttttaggtgtaaagagccctttccaccttagatttatatagttgttcctctacatatttttctagtacttatttgattttttttaacattgagatctttaatccatcagggatttattcatgtaggctatgaggtagggtttagcattgttttcaaatgcttatattacccacttgtcttagtgtcatttattaaataagccattttttcaaggttatataattttttcaaattgtttttattagaaatctatacatttcacatgttttaaaatcaagtttgaggtgtaatttacaataaaatttactcttttttgagtgttcagttagaagaatgttagcaaatatatgcaattttgtaaccactgctccattaaaaatatagaatatttccatcatctcctaaaagttatcttgtagtcctttgcagtcaaccccctctgttaatcgccttgcaaacactgatcagttttctgtccctaaagtcttacaagatgtcctataaatgaaatcacacagtacatagctttttgagtttggcttcttttactcagcataatgtgtttaagagacatccacactgtggtgtgtgtcagtagttcatttccttttattgctgagcagtattctataatatggttgtaaccacagtttatttaaccattcacttgttcaaggacatcagagttgtatctagtttttaatctattattagtgaaaatgctataaacattcatgtagaagtctttgtgtgacatgttttcatttctcttgggtaaatacctgggagtgggatttctgggtcatgtggtaagtgtatgtgttattttataaccaagtgtcagactgttttccataatgattgcactatcttatttttaccaacaatacatagagatctagtttctctgcgttcttatgagcgcttggaattgtcggtatttttaattttagccattctagtaggtgtgtcagggttatataatttgtttagaataatttgcatattttgagcagtgtttcccaactcatcccctcatctcttaacttgcccagtccatcttcagttgcacaacctgaggcagctcttgtttctgtttttcttctttccatttcttttctaagaacatctgtgcagaaaacgagcttagacataacctaatgcagggtttggtagacttttttctgtaaagggccagataataaatgattttgtttttgcaagccattcagtctctgtcacaactcaactctgccattataacatgaatgcaggtgaaggcaatatgaaacaaagaccagcattcagccggatttgacctgtggaccatagtttgctgacccctggtttagtataacaactttattttacagatgagaggaccgagctcatgtttcaccctttcctctgatttacaagtaaaagtaaaaaaaaggcaaggaccaggatattggcttttaccataagagacatgcttgaattgggttcaagataagtgtgctttatgtgtaatttcctgttctagcaaatgatgttagatgaagctcttaatatagggtctttcggcaatttcgattgcagtaagactttaggaacatcttatgttttaccattcatctcaatgctacttgactttttgaacctattatgtctctggagcaatgagcattaagaaaataaaggtaataaaggtctcagcaaaacagttggagtaagaacggcatgacatccttttattcttcttaatagattttatttccagtggtggaaatgtccaaatttgtttatttctggagatagtcattgtacatcatgtaactatctcatgattcccacctccatttaatattaattcctgattgttctgtttcattaatcattcagatagataaagattcttaggtcaaaaaaaaaaaaaaaacaggaaatcatacccctacggttccatccacacaaacctaaaaataagcattggcactaagtactcagggaaagaacactgtttagatatgtcattgtgtatgtgtttttttcctcccttctagcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcacccaaatgttttcctttggtcttattttggggaaatggtgggaggtagagaaaattggagttaaaagaagaaacattatgaaaaaattccaagccagctattttatcttataatcattcatcatgagtttctttgatgttctggctgttccggtgtgcctatgttttctgataagggcataaatacacttagtttaatattaatttagcctttgtaagcagcacttgaagggacttaagtattcaataaattgtagttatgataattaatggaaatggagggttggtcctttctaatattaagctaaagtggaatgcaatatgattaatgatatacatgatgtgcaatgtctagtcacaagggaatat[131 bp omitted]taacacggtgaaaccccagctgtactaaaaatacaaaaaaattagctgggtgtagtggcgggcgactgtggtcccagctactcaggaggctgaggcaggagaatggcgtgaacccgggaggtggagcttgcagcatgccactgcactccagcctgggcaacagagcgagactccgtctcaaaaaaaaaaaaaaaaaaagaaaaagaaaaaaaaatcagttttcaatagctgtccttttaaaagctggtgatacagtttcatattttctataactacagcaaaatggttttaatgtcatggaggttttcttcccctcatttgtgttaagctcaaggagtgtgtcttcagccagatcacatttgctaattaccctgaatctttatagaatccaaaccctagggaaagagtgagggtgctgatcttggtcaagttatttatctggaattatccaggaagattctgaaaatccgtttctaggtaagtgtagctgttttgttgttcttgttattttaaaataagaaacctcttttctgattcttaacacatcaacagtgagtattacaacagaaaacatttaaaattgagaacccccttgaggtcgtaaatttgtgtgagatctatggaaaacaaattcctgtagccacaaacatgatcactttgtctcaggggtagaggagccagagtgatctaagcacatttgatttccagaggaatttatcatttccttgtttccatgaactcttgctcttttgaaggtgtaacttatgctcacatgaatagcacattatgctactaacttattagtagttttaaaagaaagcaagaggacaagaacatttatttcagagactctgttttcttttaaaccctaacggttgagtcaaacaaagtcttttttgtaaatactgtagctaaatcttggcatgcttttactttaagcaagggaggagttttactgacatttggatgtgctagatatttttgacatcaatccccaagatgatttcttcttgaaggttctctggctttttactatctttcctaacggtcacatttttagtttaccattagcaacaggaaaatatttaactgctggttttcagcatttattgggtagaccattataaaaagaaaattaatagtttctgagtggctcctatgtgccgagttacatgtgtgatttcacataatctgtatgctggtcccatgagttaggttgtgttgttaacgtcattttacagatgaagaaactgagacatagagcgattgagctgtgtatgcaagatcacatagctagtaagagactaagacaaaattgggaagcaagtcagcctgactttaaagcctgtataatatagtcagtggtatatttacttgtccccaaaaggcagttacctaaagaaaaaaacatcttatttcgcattttgccaaattgcttatcaactggaagatttctgattttaaatcattaattgcaaagtgagcattttatagcatcttttttgttttgttttgtttttttgagacgggattttgctcgtgttgcccaggctggagtgcaatggcacaatctcagttcaccacaacctctgcctcccgggttcaagggattctcctgcctcagccccccaagtagctgagactaggtgaccgccaccacgcccggctaatgtttgtatttttagtagagatggggt[147 bp omitted]tacgagctagacaatgtgttatgtaataggaatttagaagtcaataagatttggcttagtatcaggtggttagttaagggaaggctactttgtataggggaaagaaacctggattatcatttaggagttccaaatgaatgtgggcagataactttctctgtctgggtctgtttccctatctgtaaaatgaaggtgttagacagtgatgtataatcccatccatgactcctaatggtgaccataggttgtggagttcatttggaagtgagaatctttgctataaacactagctctaggcatcagcgttctcatctgtaaaatgaggaggttggactagattagctctattaattttgacatccaataaaggttaagatgatttttgttttacaaatcaagaaaatacctcttattcactacaggatgtagcgaaactgccaaaaataaccagaggagcaggccctttaatgcagtgggaagaacaaaggaattaatacattagatgaaacctgtggtctacccaaatcaggattttcacaagggcccagccatgattgcatctaacaaatatttcttaatatgcatgtatgatactttaaaagccaaagagtattatagggcttatcatttaaaaaaagcagcctcctgtcccactcctccttacccctgattcctgctcctagaaaagatgtcaacaccctaattctgggacctgtggctatgtaactttacatggaaaaaggaactttgcagatgtaattgtggttcaggccttaagatagattttcctggattatctgggtgagcccaatatcaagcccttagaagccgagaaattggctgctttggctgaaagcagaagagggagaaagagccaaagcacaaaaagggctcaaagtgctgttgctggcttgaggatgtaaggggccatgtaggaagtgtgagaaggaactggatactaccagtaacttgagtgggcctggatgcagattttctcccagagcctccatataggagcacaagctggcagacaccataatctgggccttgtgagaccctgagcagagagtgcagccacactgtgctggacttctgacctacagaagtgtgatataatatgtttgtgttattttaaactacatttaacatgttttacctgtttcttttggtatataaccctttacttttgaataataccctaatattgcaatttctttagatttagaaatgatctttcttctgtagaagatgaggaattagcttgcttttatgcctctcaacacgcacttgtgcacacatactcacacttctcttccaaaaatataaatattttcgttaaaatagtcaatatttgcattatacttatataaatattgcttgtggttaacttatgcactgtaccattaattatatttttttgtttttttccccatattgtctcccctttatttttttatgtacctgtcatgagttcaatcccaaacttttccccatattgtctccctttctttgatttatttttgtatgtacctgtcatgagttcaatcccaaacttttctgaagaaccataacacttcactcaatatgatcaaacatgttaggtaatccatgagtttcatgaatttttggggggagacagccctctttagagtttgctgccctcctgatccatcctgaaatggttgttctctaggccgagcacctagctgccatcctgggaattccctccacttccagcttctgtttcctgcattcccagttgtcccccttcttggattatgccctggttttgctggaccacaccgtttactaagttccttagaaaggttgcatgggaggtgatttttatttttttcagacagggtctcattctattgcccaggctagagtacagtggtgagaggggacagcgtgctggcagtcctcacagccctcgctcgctctcggcgcctcctctgcctgggctcccactttggcggcacttgaggagcccttcggcccgccgctgcactgtgggagcccctttctgggctggccaaggctggagcccactccctcagcttgcagggaggtgtggagggagaggcacgagcgggaaccggggctgcgtgaggcgcttgtgggccagctggagttccgggtgggcatgggcttggcggggcccgcactcggagcagccagccagccctgctggccccgggcaatgggggacttagcacccgggccaatggctgcggagggtgtactgagtcccccagcagtgccggcccaccggcgctgtgctcgatttctcaccgagccttagctgccttcccgcggggcagggctcgggacctgcagccctccatgcctgagcctcccacccactccatgggctcctgtgcggcccgagcctcccggacgagcactaccccctgctccacggcgcccagtcccattgaccacccaagggctgaggaatgcgagcgcacagtgcaggactggcaggcagctccacctgcagcccctgtgcgggatccacgaggtgaagccagctgagctcctgagtctggtggggacgtggagagtctttgtatgtagctcagggattgtaaatacaccaatcagcaccctgtgtttagctcaaggtttgtgagtgcaccaatcgacactctgtatctagctgctctggtgaggatgtggagaacctttatgtctagctcagggattgtaaacacaccaatcatcaccctgtgtgtagctcaaggtttgtgagtgcaccaatcgacactctgtatctagctgctctggtggggccttggagaacctttatgtctagctcagggattgtaaacacaccaatcagcaccttgtgtttagctcaaggtttgtgagtgcaccaatcgacactctgtatctagctgctctggtggggccttggagaacctttatgtctagctcagggattgtaaacacaccaatcagcaccttgtgtttagctcaaggtttgtgagtgcaccaatcgacactctgtatctagctgctctggtggggccttggagaacctttatgtctagctcagggattgtaaatacaccaatcggcactctgtatctagctgaaggtttgtaaacacaccaatcagcaccctgtgtttagctcaaggtttgtgagtgcaccaattgacactctgtatctagctgctctggtggggccttggagaacctgtgtatccaaagtctgtatctaactaatctaatggggaggtagagaacctttgtatctagctcagggattgtaaacgtaccaataagtgccctgacaaaacaggccactgggctctaccaatcagcaggatgtgggtggggccagataagagaataaaagcaggctgcctgagccagcagtggcgacccgcgcgggtccccttccacttctttcactctttgcaatatcttgctactgctcactctttgggtccacgctgcttttatgagctgtaacactcactgcgaagacctgcggcttcactcctgagcccagcgagaccacgagcccaccgggaggaacgaagaactccagacgcgctaccttaagagctgtaacacacaccgccaaggtctgcagcttcactcattagccagtgagaccacgaacccaccagaaggaagaaactcggaacacatctgaacatcagaagggacagactccagacgcgccaccttaagagctgtaacagtcacggcgtgggtccgcggcttcattcttgaagtcagggagaccaagaacccaccaattcgggacagtggcatgatcacggctcactgcagcctcgaccttccgggctgaagtgatcatcccacctcagcctcccaattagctcggactatgggcacataccaccatgcccagctaagtttcattcattttattttatttattttttttgagacagggtctcacttttatcatgcaggctggagtgcagtaatgcgagctcggctcactgcaatctccacctcccaggttcaagcggttctcctacctcagccttccgagtagctgggactacaggcacttgccaccatgctcagctgttaatttttatttttttgtagagatgggggtctccctgtgttgcccaagctgatgttgaactcctgggctcaaacaatcctcccactatggcctcccaaagtgctgagattacaggcatgagccattgctcccagccaagatgatttttgtaaaatcattttttgtctaaatataatcttcacacatgattaaaatttttactaggtgaagaattactaattggaaacaatttcctctgagaatgttgaaagcattattccgatgtgttgttgcttctagtgttgctttagaaatgtctgatttctaattttctacatgtaacttttatctgcaaggttttctcttggcctcttttctcttggtgttttaaattttaatgatatgccttattgtggatcttcttccatttactgggctggactttgtgagccctttcaatctaaaatctcatgcttcatttttaagacattgctttctattatttctcacacaatagcttcccttgtgttttctttatctctaggattcctattagttgtacattggacatcctggactgattctgtaattttcgtatcttttttctcccatgttccctttatttgtcttttggttctgctttttgggagattttcttaacttgatctacctgaggctcagtcctcatctgtaaaatgctgataaaaggacctaccacctagcgttgctgtgaggtgtcagtgaaataaaatgtaaaatgcttagcacagtgaactttaataaatggtagttgtggttgcacatactgttattctggaaccaatttcttgtccctcctcatgtgaaaatgacaatcttggtttacaatatcatactataatatttgccttcattgtagtgaatttgtaatgacatggcattttccaattatactgtttttagaaaaaaattctatggtataaatccagttagcaacattaattcttatttatgcttctacaaacacttaaaagtattttttttcttttttcttttcttttttccactctcccctcatccctggggtagatgagaactggaaaaataatgctgggtatccactccctgacagtgaaataggtagtttggagccccaattaattactttgttaggatgagagtgcagatcaaacctttaacatgtgagggttgccgtacactctgcctgctatgcagccccaaataaggctggccagtacctaggagcactgaggaggctaatggacaattaacaaacatcgagtccagaggaggcctggattctctgtaagctttgcagccaaaggtggccctgcctgcccacttagggccccatgaagactagaactagaattacagaaaaagaatgtctgcaagtcaagaacaatctggctttactactttattttcattccttcatctgttcagttggggggcgatgttaaagctatgtgacatgggcaccaaccagtcaggtcagatgctggctataattacttggtaggttatgtatcaaccctggattcaacagatatttattgagtgtctaccatgtgccagcactgtgctagctaggtactgtatgatgcagggcaagtttctttctttctctgagcttcagtttgctcacttgtgaaaaaaaaggagtaagtgatctacaagggctcctttaggtctaacattcgcaatcaataaaatagtaacttttgattgttttgggaaaataatggaaacagctatagaaaacaagcagctgacctaagacttgtagatttgaaaatgggggaaaaaacagaaaattattctgagttattgtttgacttgagatttggattaagaatcagttctacatgtcttattttcatgatgtttccaaagggagacaaagatagctctaatcaaagggtgagtttgttttacagccttgaacattcaagctccaccccactatcccccaccaacatgcatatacaagacaccttccccctaaggaggctactactttcttttagcatcctctctccagctgctacacttcaaaccctttcgttcagtggttggcaatagcttgtccactctggcaagagtccatgttccaagcctttcttaacttcctcttttcagacttgtcctgcctcatttcctgttccttgtggcctctgcctcataagatgtttgatcaattcatctttgctaatgtagccaaggagggctaagaagtttgtgggttaccatttctggataaaattcatattacaaggagcctccccaaaccatgctaccacttttatggtggattaaaaaaatattatgggaaagttcaaacatatatagaagtaaggagactgttacagtgaatggtcatatacccatcaactagcttcaacaattatcaaaatggtcaatcttatttcatttatactgccacccatttcctacttcctacatgacgaattatttttaagcaagtcccagacatcacatcatttcatctgtaaatactttagtatatatctctacaaactaaggaccctttttgttttaaaaaactgcaataccattatcacactttaaaactaaacaataattgcttaatattctcaattatctagtcagtgtttacatttccccaattgtctcataagtctttttttcctacaatttgcttgaatcaggatccaataaggctcacggtgattttttaaataatgatgctttgtaatatacaggggtgagaatttgggaacaaatgattgtttggcctttaaaatcgtactacattggcatttaggaatgaatacagccctgctgccacaaagtagctctttttcccttccagattgctttgactaaaaatttgtttagcatcccattggattctggaaattcttcttgttttctcttttccttccttccttccttccttccttccttccttccttccttccttccttccttccttccttccttcctctctctcttttttttcttttttctttctttctttctttctttttttttttttgacagagttttgctcttgttgcccaggctggagtgcaatggtgcgatctcggctcgctgcaacctctgcctcctgggttcaagtgattctcctgcctc[133 bp omitted]tcagcctcccaaagtgctgggattacaggcgtcagccacagtgcccaacaaattctggaaattctttataagcgtagtcagacatctgtgaaggaagtgaaaactgaagtttggccttgaagcttagaagttctcacacaaccaagacatagtcttccttaaaacagaaaaaaaacacagccatgcatacacacacacacacacacacacacacacacacacacacacaaatgccaacttctaatatgtctacggaatgtttttgcaaatggtagtacagagcatatctgtgttgtgtaattttttcccacatgataaggaccaatataaacaaattggaaatgtgatactaaaagagagtacttcagcatggattaattaagaccaatatggggcaatccttttctgatattttacaatgcactgaaaattttaaagcaaggtggaaaaataggcttatgggtctgaatgttaggttgagaaaaattatctgtggtcaagtgtgtgctttgtaaatctgctgagtttacacttgatcatgcagttttctataagttgctggcttgaataccactgggaaatatacagaccatgtgactatgaaaccaacccaattgtcccacagagctgatgtttctgatctctttgaataaacatagaaattgatccttccagtcttaaaacttgagaaagttacatttgtcttatctgaattcctttctcaggaaacaaaccatcaggcctcccagaaagtatccgggatctgaaaatcaccaaatcaccacatccggacagtgagaagccagatccctcacccttcttgattggctgacaaaccaactgcttcctgttgaccaactcctcttccttatccctccctaattcctgttttcccacacatggtttcacttcttccctgctatacaaacacctaattttagttggtcagggagatggaattgagactgatctcttgtctccttggctgctgcacctgattaaagccttcttccttggcaatactcattgtctcagtgtttgcctttctgtgcagtgagaaaacaggacctagatggaactcctgctgttttggtaacattactacagacctctcagaatggctaaaataaaaataatgacaacacctcaataatagtaaggatgcaaagaaatcatatcactcatatatttcttgtgggtacataaaatggtacagctactctgagaaagagtggcagtttgtttaaaaacgaaacatgcaactatcacatggtccagcaattgtactgttgggcctctatcccagaaaaataaaaacatatgttcacacaacaaactttacataaatgtttataatggttttattcataatttacaaaaactagaaaaactcagatatccttcaatgggtgggtgaatggttgaacaatttttggtacagtcacatcatggaatactacttagcaataaaagtgaatgaatatcacctcacgctcattagaatggccactataaaaaaaaacccataaaatagaaagtgttggtgtggatgtggggaaatgagaatccttgtgtgctatttgtgggattgtgaaatggtgcaacagccatggaaaacagaatggtagttcttcaaaaagttagaaatagatctacctaggctgggtgcggtggcttacgcctgtagtcccagcacgttgggaggccgaggtgggcagatcaactgaggttgggagttccagaccagcctgaccaacatggagaaaccccgtctctactaaaaatacaaaaattagccgggcgtagtggtgggcacctgtaatcccagctactcgggaggctgaggcaggagaattgcttgaacctgggaggcagaggttgcggtgagctgagatcgtgccattgcactccagcctgggcaacaagagtgaaactccgtctcaaaaaaaaaaaagaaaaaaagaaaaaaaaaagaaaaaagaaaaagaaatagatctaccatatgactcagcaatcccacttctgggtatttatgcaaaagcattaaaagcagggtcttgggatatttgcacacccatattcatagcagcagtattgaaacatggagtctgggagcagcattcctatgatcagtgtctatgctattccactttgtgcttttattaattcattcaagaaggcttttgacgaatatagatcgtgtacgagatgctgtagtagattcaaagaatagagcatgctttcttttcttttttaaaaaattgagatggtgtctcactattttgcccaggctagtctcaaactcctgggctcaggtgatcctcttgcctgccaagtagctgggactacaggtgcagtgcatactttctgtcctattattgctgatagtccagtgcaggaatggcaaatttgtttccttttgtggatcagttcttctggaatactgtttcccgaaggattttgagattgggtttgggctcagtgggaagatggctaagatctatcagtgatgtctcttgttgggtactggtgggggggtgttgatgtacttgtgccacatggttgccaccttggctaagggctagagtgacatatttatgtatataaataatggattatcaacaagacagaatattagcaattagagttatgaaaggaggtccaagtaaagtgctgtatacaggcagtggaaaaaatgatgggggtgtcggggctgggaggatacccagaaaagttttttgagggcagtgctagttggtctgcacattaaagcaagagtagaatctgaagagattaacaaaagggggcatccctgtcctcagaaggagtttgagtagagtggaaggatggattgtgagagaaagatgacagagataagcagatgacctagggattaggcaagaggtggagaggatccgctccatgcctggcaaacaggagaggaggacacagatctgaagtagtttagaggttgactcaccaggactccatgaatgggagggagatgctcaaaatgttatagagaagcacaggcttgggtggggaatggggagtagatgagaaatacgaatttcattttggacatgttcactgtagtatgctagaggaaccattaggttatgatttcctacagggttggggacactcacggatggcaatgagaggagggcagcttcaagagtcagggttatgggagccagctgccagggaaagaccaatgaggtcattcccaaaataagacacattgcaagccctctcagcacagtgtgaggacaacccaaatctaagctagctctgggggcagtcatggcatggtaggttagatgtcaaagcagagacttcatcacgaacttggcagcccaagagtaacacactgctgccatctgggggctgcatgtagaaattgtaatggcagctttgtgaaagccacttaatgagagaggacattattttggaaccagcaagacccttcctctcaaaagccttttatagttcttccttaaattcttttctgcctagttctacttctctgtccccaatgaaggaaaccatgggtgcacatgttctgtagcatatttccagaaggactgaacccctgaaagcagaatactttcagtcagctacagcatcctagcactggattgagatactccatgctgctgctgctactgtgctctagcaactgaccaaagttcttgcctgaaccaccctctgccggatctcccaaatcccctcattttgacttcatcactgcctggttctgacctttgatactagaatactgaatttttgcctccaggggcacaatttactcttctatgttttcttttgctagcatctttttcctaagtggaactggattttcatttactcatttttcattcaacaaacatttattgagtggccacagtgtgtcaggtactaggatacatttgggagcaaaaatagatgggtcccctcagaaacctgtattacagtctaactgtaaagacaaaacaatcattttaaatgtgataattgctatgaaggaaaggtcaatgatgcagtgagatgtagtgaggtgagatgaagaaaaggtcgatgaggctgtgagaacaggtaacaggggattctgacctagtcttgcagggtagcaaaaacttttctgaggatgtgacatttaagctgaaattttaaggattggtaggaattagccagaaattaactgttctgaaaactatgaaacctataagactgggaaagaaggggccatcctccttgttcctctgtcttctacagtggtaatacagcagggagattcaattgctttacataggacagtctctaggaagatctttcattctgaattagcatgtcaactacagtgaaaacatgtctaaaaaataacaattacaacaactagaaaatcaggaaatgtagaaataaagaaccccccctaaaactcctccaaattagactgccctaatgaaaataggaataggtataaacagacaaagaaatactaatgttcttgaagtcttgaaatactatcttttggtttatttcttttcatttttatttttcatttaaataattgaaccgattttttattttttgagacagggtcttgctctgttgctcaggctgtggtgcagtaatgtgatcacacctcactgcagccttcaattcctgggctcaagcaatcctcacacctcaacctcctgaggagctgggactacaggtgtacaccaccacaccaactaatttttttttttgtatttttagtagatacaggattttgccatgttgtccagactggtcttgaactcctggggtcaagtgatctgcctgcctcagcctccaaaattgctaggattacaggcgtgagctgctgtgcccagccgaactgctttttaaaaatctccatatacacttatttgaacaacttgatcataatttctgaaatcttttaacacatcagacctgaaccaaatcaagataccaaaacccacctgagcttcagatgcctcattggtaaaatagggattatagtatagtaatagctacatcttacggcttttggagacttaatgagttgacacttacaaagcacaccattgccctgctcattgtaagtgcataatacatgttaatattattattccagggctgacctgtttgtagaaggtgtcaggggaaaatatttccaggttgatggaacgttgaggttgcttcaaccccatgccatggttggttacttcagctacgcaaggaccagccccgacatgagaaatgataagtgaaaaaaagagaatcaagcccagtacatagcatataattcacctggcctgcagaagtacacacaaaagcttattctgtagttcatattcataagagatatcccctccctcgttcctaacaggtaatcgtctagtctctgcctaaatccctgcagcaacagggagtgccctatttatggagaaaggccattttatttattgatagttctaattttctggatctatcttcaaattccagagtaaaaagtcatttttatcatgtatcttcccattaatcttccttatgccctggagaaccaaacagaacaaaaaaagtcctcactcaaaattggcaaaattgagtaaggacatagattacaatattgcatcaactatcaagtgtcctaattttggtaatggtcttctataagaatggctgtgtccctgggaaatatgcattgaagcattagggagtaaaatggcatgatgcatgtgacctgcctgcaaatagttcctaaaaaaaaagaacattaatatgtaagtaatgagagagagtgataaaaacaaattgccaaaatatttaaaattggtgggatctgcatagatggtgtatgggaattatttgttctacttttacaactcttctgtaatttttaaattatttctaaataaaaagttaataaaaatcctgggctgggcatggtggctcacgcctgtaatcccagtactttgggaggctggggtgggtggatcacttgaggccaggagtttgagaccagcctggccaacatagctaaaccccatctctactaaaaatacaaaaattagctcggtctggtggtgcacacccatagtcccagctactcgggaggctgaggcaggagaatcgcttgaaccctgtaggtggaggttgcagtgagccaaggtggcaccactgcactccagcctgggcgactgagcgagactctttctcaccaaaaaaaaaaaaaaagatagtaaaaatcctctctcttccatagcaaagctcttcaaaggtttgagagcaattaccacatttattctgttctacatttccatctcacttatttgcttactcttcactcattcatttattctttgataaatattgattgagcacttgctttgtactatgcccagagctgggcactgtggaagtggtggagaagaaagtcaattctacctggctctcatggaattcaggggcacttggtggagtccaaaggtaatcaaattattctacaagtaattgtattatttctaactctgatagggctatgacataagaatcagggagggtgggatggtatgagagagcctgccagaacgttctgaacctgctaagtggacccagcatttaaggttgtaggggtgcaaagggcagtgtgccaaagagattagcattcctttatgaaaaatctcttggctgaggggaaggatttgtgagcccaggtgagcagctttggacaagctgttccatttgtcaagttgttccatctgcttccttaagtgtcacaaagtattgaagagagattgcctgggcttgaatgacagctgctgtttcctagccatgtagttgtgaaagaggatagcagagccttggtgccttcacgcagattgagacccttgtcccccatcaatcatagctatgtctgatggcatggctatggcagttgggtcccttgccacacaatttcaagcctgggcctgagttgagcccagatgagtcctgggaacagaaactccaacaggaatcatgtcagtttctgtaacaggatttgccttgcaacctagatgagaaaactgagctttagagtcatcagcatgtattttttttcccaagaaaaatagccattaaatgtgggggtggatttgaagatcaagctgagaatgtgcatgtgaagcttagcacttagaacataatatgcctccaacaaatggcagctatcattcttttcatcactgataccaaggtgggctgagtgaagaaaaatgaggtggctgaggatgctggatatttaatacctccagggcactgtcaagggacaggggacagggctccaaatggaaggatgcaagaacttgcttttttttctttttttttttgagatggggtcttgctctgtcgccgaggctggaatgcagtgatatgatctcggctcactgcagcctccacttcctgggctcaaatgatcctcccacctcagcctctcgagtagctgggaccacaggtccacatcaccatgcctggctaattttttattatttgtagaaatgggatctccatatgtttcccaggctggtcttgatctcctggactcaaacaatcctggcaccttggcctcccaaagtgttgggattacaggcatgagccaccgcacccagccgagaacttactttcacccatctcatagttttgcttgtgatgatcacctagtattctaaacagtcagtactcgaactctagtgcaatattattcattcaatgaatgtttattgagtacttgctatatgacagacactgtccaggtgctggggctacacaaggaaacaaaacaagtgaacacttagcttcatatttctatataccatgagagttttcacagtgctttcatgtccatgatttcatctgttcctcatgacaatacaatgagataggtcctattattattttcattttatgggtgggggaactgatatatccagagattaattaattaactcaagagcgatagaacccaggccccaggttgtagtttaatgctcccttcaccacacacacattcggaacggccaccatcctgatctacctcttgccagtctccctcttgccagtgggcccccagggctttccagcctgacttctgcctctggaccccaccctcctcccccacttgctctagatcttgtctctgccacagcagtccagctgatcagtcagcaaggatttctgaagcacccagcaccatgattttaccatgatttcccaaagggctacttgggtctcagtcatttcagtcaatccagaccagcaggctggcctacattttctgaggtgttgcagctatgcagaattggttggactttttgctgggcccctctatggtggtgctttgggagggcactctcctgtgttcagataactggggcagaattagaggaattaacaaaataacagttttggatgccaggttccccattaggagtttgactctgcactccctcagatttggtggcgtgtgctctcctgctggtaatacacttcctgtgacctggaaatcctactgctatattccttaggtttggccagactttaaaacccgccagatcattgcaacttaagcaacttctaagaacatctctttaccaggtgttatttagagaacgcaagagatttacgtctgctctgaaatgttacattggcactatataaactttcccagtacacaaagctctcaggcttttggacatgttttctcctattaagtcatataaatagcttaataaaacagtatttggttaaacatcatttgaatttcccactgaatgatggttatattcaactccaagaaaacgtggaaagtgcaaaggctttggaattagacggatctgttttcaaaacattacgccacctcttaaagctgtgtgactccaggcttcttacttaacctctccgagtgtcagtttcaattacacataccatgcctgtaatcccagcactttgggaggccaagcggggtggatcatttgaggtcaggagtttaagaccagcctggccaacatggtgaaaccccaactctactaaaaatacaaaaattagccaggcggtagtggtgcacgcctgttatcccaggtagtcgggagactgaggcaggataattagttgagcctggcagacggaggttgtagtgagctgagatcacgccactgcactcctgtctgggcaacagagtgagaccttgtctcaaaaaaaatgcaattgtattattttcatgtatggtatctagaataaatggaaaataggacaataacagacatacaacagggactcagaattaatgtatctcataacgagctttagaaagaaataataacagatgccaattataaagcacttacatgtcaaaaaacatactcagctgggtgtggtggtaggcacctatagtcccagctactcgggaagctgaggtgggaggattgcttgaagccaggagttggaggccacagtgagctatgatgagtacagtgaatggccactgcacttcagcctgggcaacagtgagttcccttatctaaaaaaaatattcacaaggtattacaaggataatcttctttaatatgcacagtaacattttagctagatgatattataatctccacttacagatatggaaactgaggcccagaaggattgtgaaactaaaacttaagtggtagatgcagaacctatttggttttgctgtagagcctgcatgctttaccactatttccctatctttagtgctttgcacaggaaccaaagaagcacgtcttttaggaaagtcaaatctttttactctatccaacactctctccactcctattccctcttttaatcttacggacacttaatttaggaacccttttcttgaaatatctggaatcaatagcctggctcagtccaatattttaacaattcagtgtagtccacatacactcaggtgaatgagtttaatgttaacagtttattgaaaatagaacagatatacagaaatgtgcataaaacatgtatgtagatttttaacaaatcgttagaaaagaaatacccatgtaaccaccaagaaagatcagaaatcaaacactaggatgccacagaagccctctgtggttctctttttaatcaaagctcttctctcacccccaggcggaaccactagcctgacttttataggaatagttccatgctttcttttagtttttgatcatctctgtatgcaagtctaagcaatatagtttaggctcacctttgtttgaactttatataaatggatccacaccgtaaatattctttttctaaaaaaatctttattgtgatatagtgtacatctttaaaattcatcctttgaaagtgtacaattcaatggtttttaaatatattcagttacatgaccatcatcacaatcaattttagaacattatcatcaccacagaaagaaaccctgtacctattagcagtcactcccttttccttcctacccccaacccctggcaacctctaatctactttctatctatgtggatttgtctcttctgaatatttcatataaacagaatcatacaatatgtggccttttgtgtggccatctttcacttagcatagtgtttccagggttcacccatgatgtagcatgtaaaagcacttctttccttttatccattcattaattgatggacatttgagtggtttccccttttcggttat[137 bp omitted]ggtgaaaccctgtctctactaaaaaatacaaaaaattagctgggcgtggtggcaggcacctgtagtcccagctactcaggaggctgaggcaggagaatggcgtgaatccgggaggcggagcttgcagtgagccgagatcacgccactgtactccagcctgggcgacagagcgagacgcaatctcaaaaaaaaaaaaagtttttgtatggacataggttttcatttcttttgggtattcacctgggaatagaattgctgggtcatatagtaattctatatttaaccttttgaggaaatttccaaactattttccaaagtgactgcaccattttacattcctgtgagcaatatttcaggattccaatttctccatatccttgctaacacttgttattatctgtctttttaattatagccatcctagtaggtataaaatggtatccaattgtggttttcgtttgcatttccctgatgaccaaataatgttgagcatcttttcattggccatttgtatatcatatatattccctggagaaatgtttactcagatcctttgtccattttaaaattaagttgtctttttattgttgagttgtaaaactatatatactagataaagatccttcatcagatatataatttccctatactttctttcattctgtggattgtcttttccccttcctgacagtgtctttttttttttttttttaaactaggtctggctttgttgcccaagctggagtgcagtggcgtgatcttggctcactgcaacctctgcctctcaggctcaagccatcctcctacctcagcctcccgagtagctgggattacaagcacatgccaccgtgctggctaatttttgtattttttgtagagacgggtttcaccatgttggccaggctggtcttgaactcgtgagctcaagcaatccacacccttggcctcccaaattgctgggattacaagtgtgagccaccatgcccggccctgacagtgtcttttgatgcacaaaaattttaaattttgtgagccgagatcgtgccactgcactccagcctgggcaacagagtgagactctgtctcaaaaaaaaaaaaaaaattaaattttgatgaagtctagtttttctgtttgttgttgttgttgttgttgcttatactttggtgtcatatctaagaatgctttgcctaactcaaagacacaaacatttacttctatgacttcttagagtttttataattttagcttttatacttaggtctatgattcattttgagttaatttttgtacatggtgtgaggtggtagtccaaattcattctttgcttgtgacatccatttgtccctgcaccatttgttgaacagacttttgtttccccattgaatggtcttgtcatccttgtcaaaaattaactgaccataaatgtatgagtttatttttggactctcaattctattccactgatctatatactatccttattccaggaccacacgattttgattactgcagctttgtagtaggttttgaaattgggaagtgtcagttctccaactctgtttttctttttcaagattgttttgactattctgggtttcctgcatttctttctttctttcttttttttttttttttgagacggggtctcactctgtcacccaggttggagtgcagtggtgtgatctttgctcactacaacctctgcctctcgggttcaagccatcctcccatctcagcctcctgtgtagctgggactacaggctcaggcttgcaccaccatgcctggctagtttttgtatttttaatagagacagggtttcaccatgttacccaggctggtctcaaattcctgggctcaagtgatccgcccacctcggcttcccaaagtgctgggattagaggtatgagtcaccacacccggctccctgtatttctgtgtgaattttaggatcagtttctcagtttctacaaagaagccagctgaaattatgctagacataacattgaatctacagatcaatctgtagattgccattttatcaatatttggccctctaaaccaggatgatcaaatgtctttcatttatttatatctttaatttccctccacaatgttttgcaatttttagtgtaagctttacacttcatttgttaaatttattcataagtatttttgatgttattgtaaatggaattgtttccttaatttcatttccagattgttcattgctagtgtatagaaatacaattaaattttgtataacaatcttgtattttacaatcttgttgaactcatctattagttctcatagtttttcaatggtgtccttagaattttccatgtacaaaatgatgtcatcgttcaattcccacctatgagtgagaacatgcggtgtctggttttttgtccttgcgatagtttgctgagaatgatggtttccagcttcatgtaaatgacgagttaatgggtgcagcacagcaacatggcacatgtatacatatgtaacaaacctgcatgttgtgcacatgtaccctagaacttaaagtataataaaaaatgatgtcatctatgaatacagatggttttatttcttcctttccaatctggatgtcgtttatttcttttttatcttgtctaatttcccaggctagaacccctaatacaatgttaaatggaagtggcaagagaggacattcttgacatgttataacattgctttctatttcactaatttctatttatcatattatcgtttttaaattttattgggcttattttgtttgttttcttacatcttgagatggacaattcattaactcattaactcgtggattttcatcattgcttacagatacaagggtgggtttttttgttttgttttgttttgttttagagacagggtctggctatgttgcccaggttcatgtgatcttcctgtctcagcctcctgagtagcagggactacaggtatgcagcactgtaccgagctcccacaatttttgatatgagtatttccattattgttcagcaaaaaatatttttaatttcactatcattgttctttgactcatcagttattttagagtatgtgtcttggtttccaaacatactgacattttccagttatctttttattattggtttgtaacttacttgcattgcaatcagattttaattctttgaaatttgttgaggcctgctttctggcctaacatatggtcaaattttttttttttttttgagacagagtcttgctctgtcgcccaggctggagtgcagtggcatgatctcggctcactgcaagctccacctcccaggttcacgccattctcctgcctcagccttccgagtagctgggactacaggtgaccgccaccacgcctggctaaatttttgtatttttagtagagatggggtttcaccgtgttagctaggatggtcttgatctcctgacctcatgatccgcccgcctcggcctcccaaagtgggtcaaattttataagggtgttgtatgtgtattctgtagttgttggctgtggtgtggtgttctatatattggctattagttcattattaataacattgttcaaaaattctatatccttagaggcattttttgtctccttgatcaactactgagagaggtgtggtaacactttccattctaattttatatttgcttatttctcctttagtaaattaattttcctttatatatttcaaggctttgttatcagcataatcattcaaatttgctaaacttcccggtgagttggaacttttatcataataaaataaccttctatatctctcgtaatgctttttgcttttaagtatattttgcctgctatgaatatagctatacaagttttctatctgttatatattatttgcatgatttttctgtctccatgtttttactatcaacctatgtgtacccttatattttggatttgtctcttttaaacagcatgtagttgtgtttattaatcccatttgacattattttttaacttgagcctttagcttttaaaatcttttatgttttgtaattttaaaaatccttttattgatacatactatttatacatatttatgggatacatgtgaccttttgatacatgaatacaatatttaatgatccagggtaattaggatacctatcaccttgaacatttgtcatttctttgtgttgggaacatttcaaatcttctcctctagctattttgaaatatacaacatattgtttttaactatggccaccctattgtgctattgaacactataacatattattttaatgtaagtcattaactaatctctcttcaaccctccccacaacacacacccttcccagcctctggtaacaatcattctactctctaactccgtgagatacacttttttagcccccacagatgagtgagaacgtgcaatttttatctttctgtgcctggcttatttcagttaacgtaatgacttccagttccatacatgttgctgcaaatgataggattttattcttttttatggctgaatagtattccattgtgtatatatactccattttctttatccattcatccattgatggacatttaggttgattccatatcttggctattgtgaatagtgctataataaacctgggggtgcaggtattcattcaatacactaatttcatttcctttggctatatatcatatgatttctggatggtatgatagctctattttttgttttctgaggaacctccaaactgctctccatagtggctgtactaatttacattctcagcaacagtgtataagagttttcttttctctgcatcctggccagaatttttaatttttatcttttgataatagccatgctaactggggtcactgtggtttagatttgcatttccctgatgattagttgagcatttttttcatatatttcttggccatttgtatgtctttgagaaatgtctattcagatcctttgcccacttttaaatgggattacttggggtttttgatgttgtggatcataaacatttaataaaattattcatatatttgggtttaaagcttaattttattttgtgcttttatttgtcccatttatatttctttcttgatttaaaaaaaattgaaaattttgtgttgattattcaactttttcccctccctactattgatagcttggaaatttacatcctgttactattattttaatagtcacatactattaattactagatatataattaccttatcagaatataaatttaataaatacctaaataacttccaatacgataccaggcccttagaaaagttgaaatccatttaagcccctcctgacgttttttctgattgtatgatacattaagtttattttttaaaaagaagaatagatgtttttctgatttcttcttctgccaatgttctcttacattgcccacgtactaccacttcctttgctcttcattccttcctgtatttatttcttttaaggtcatgttcctcctgaagtacatacttcagaatttccattagcttggtttgctggttacaaactctctgttttgtttgtctaaaaataactattttatcctctttttgaaaacttttttgagtgatgctgcccttagaatgccaggttaatatgtgcagcatctcccataagcacccccatccagtctttgatatccctgagccgaagcccgagtttgaagtgaccatatgctctcagaaaccttggtgaaataacaatgcctatctgaataggtttgatgagacacttacatgagataaggatggaaaattcctggcacagaggttgaaggcaactaaagggagttattctttcaactgaaggcattggctctgaatcttaaggattttaagggttttttgtgtgtgtgtttttgttttgttttgttttgcaattggaaaatgaaatgtggcctccttagaaccaccagagctagaattcttgtaattggaagcccccttacccccaacccctctcctataatatgaggccagagataaggtatgctctgtatccaactggagccagtttagcaaatgctcctccaagccctatatgaagagacctccgcttggttctgatgatgcaacccaggcaactttacacaatcaaaattttttgcacagctctgagacacagtctttgtcctttctgatgccaccaggtccaactgcagaacacctgatttggcgatgaagccaatttaaatgtagaacacgattctgcttagaggccagggtcagatgtcatagtattggggagcagaagcaagagtctgaagaaaacccctaagctattgccagcatcacccccgactgtgtgaagtaagcaacctgccttctctgcacctccaaaatcctccacccaccaccaccaccattccagtgttccatccacaagagaaaggtcatgcccctgagatgaaggtgctttgtctttaaatgtagattgtttactccaaggaattctaggtattggagttggaaataagaaggcagaaagaagcaggtaaagtaccttggcaggctgaagctgaaattaacagcagctgaaaagcatcagactgttcactcacttccaaacatcaggagtcaagaacaagcaactcctttgcacttgggcagtccaagtgcacttggtcttgaccccccaaagttcccacaggagtctcttaaccacactttacatgagagaaggaaggcttgctttcccagaaccagaagtaagggaaaatggagtgctgcaggctgaattatgttcccccaaattcattgtaatcctaaccctcagtaccttagagtgtgactgtatttaaagatagggcctttaaagaggttattaaggtaaaaatgaggcccttagggtgggccccaatctgacttgtgtccttataagaagaggaaatttggacacactgagagaacccagaggcacatatgcacagagaggatggccaagcaagagggcagccatgtgcaagccaaggagagaagcctcaggagaaaccaaccttgctggcaccttgaagttggacttcccaaccttcagaactatgagcaatacatttctgttgtttataaaccacccagtctatggtattttgccatagcaccccaaacagactaaaacagcactgtaacaaattatcacaaacttggcttaaaacaagagaagtttaatttctcacagttctagaagccagaagcttaacatctgtttctctgggctgaattcaaggtgtcagtaggactgtgctttattccttgcctcttccagtttctggtggctgctagcattcctctgcttatggccacatcactaatctctggtcattgccttctcttcttggtgcaccaactctccctcttttataagggcacttgtggtttagatttcagcctgcctggaaaattaagtcaaaaagccttaacttaatcacacctgcaaagaccattttactttataaggtaacatttacaggtttcagggattaggacttgatacatttgggtggccattatttagcttcatacagagtccgaaatctttgcatacaatttcaggaagatcatggattccaggtaggcacatctgctctggagttgcatttcaccacagatacctgtggacagatattggagacaggctcatttacttattcacaaaccttgctacaactcagaaccaaccgcagcgccggttaaaaatactaaatacaaaaccacatcacaaccgctagtcctagtaaatctgaatccaccagagttggggcccagagcctacatttcttttcttttcctttttttttttttttttttttttttttttttttttttgagagggagtcttgttcccttgccaggctgaagtgcagcggtgcgatcttggttcactgcaacctccgcctcccaggttggagagattctctagcctcagcctcccaagtagctgggattacaggcacgcgccatcatgcccagctgatttttttttttttttttgtctttttagtagagacggggtttcaacatgttggccaggatggtctcgatctcttgacctcgtgagccgcccgcctcggcctcccaaagtgctgggatttcaggcgtgagccaccattcccggccagaagactgcatttctaacaagctcccccaaatgactctgatgtcttgcccccatacttgaatgggtattggttgagagccttgttctccagctctcctctctgttaaatggacatactgctacttctttcacagtaaaagaggagatgtgtgtgaaagcctgtttccgcaatgcacgtgctaatgctcttcccgccccttcccctcttccccgtcttttccctataccaaggtgaagaacttttattattcacttgattttggacccacttcgtgtttaatgcacctggcctaagatgcagagttgagcccagggagaagggacgggttgggggaggaagaaagagtcgcaaattcccaggcagattggctccatcggtctaatcaagctgcacttgacgctccgcgggcctgctgcgcccccgccccctcaggcgaaaactcgcctctgcccaaggctgtgcggggcgtccgcccccgcacttcgctgattggccgcactagcccgctcgtcacgctcttttgtctcagctggcagaggataaaagccgccgcggctgccttaggaacggcgctgcctcgtctctgctacccctggttgggcggccctgcgaagcagctccttcgggcagccccgggtcgcttagcggccaaggaggcttcagttctttgccgcctgcaaggcggagaccagaaggcggaatccacagctggcgacgcgggagcatctgctgtccaccagcggagcacaggtaaagaatgggggtgtgattgcccggcggggagaggggtgggggaagacccaccagtactgggcggctcccagcttggagaatcggtgactgtgaggcaggggtaggagtactctcgtggcccggctgcgctgagggaggaggtggggttcacctggatactgcgggctaggtaggatttgcctggatttgggggtgggaggagaggcgaggagtagcggggggaggaatctcgagctgtttgcttcgaacatcctttgcatctcctcatctctttctgggaggaatatgtgggtgggtgtgtccaactcctattccctttctccgtggcaggccatcaaagccgcatctgaacttgaattctgtgcagctgattgcagagctggtaggccgacggcttcccgggggaaatgtaatgctggagggtggggggctggtctctggcttatagtcaggagggggcagagagaatttttcgcctggcaacagcggaggtggtgggtagcaggatgacgggtgaagctgcttctaacccttcccttctctggccttctccgctgtggcgcaatcttgaaacctcaaggacccggatctgcgaccccctgtggacagaggttgaccgtaccccggagaggagctttctcacggagggcactggttgcagaggctggaagtgaaataaagacgcgctcttgtttcagagttcgtgtaagaatctgagaaataacaagggggacgggcgtggggggcactttgagaagggggtgtggttgagaccagagaccatgaggttaatgagatcttattttatttccacaaatctgcgatcattgtactctatttggagagcccaatatcagctccagacactgctacacctagaatttgaagcaacagttaccgtccctcttggaggactggtgggagggatggatgtggctgcaaaaagcaccttgctagcacgcaggcatcgggtagctctgggaggttgtaagtgtcaatctcctacaggattatttttagggtagtgggcaaatataaaatgtactgcaggatattcaggtaggaagagaatgcagctgcagcccgctcccttattaaccagcccccctttcttttttacagcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagtagaaagggtcttggataccagcacattggagggagatagcctgacctctgtccttgctccttctccctgcagcctacgggtctgttttctgtgtgtgcccatttccttgacagctttattctttgtgaaagtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagcatctgccttaatgtgtctgtgctgttaggaagaatttttaaaaaagaaaatatagtaaaaaactgtaaaggggggttgtactctgaggtgggatttttaaccgcattttgcaaatgaaaaaaaataaatgggctgagatacttcccaaaggtaaaaggacagagcccccttaccacaactaacctgtcccttcgctcagagagccaaattgtgacacccacttgttgacaaaacaccagtgctttcttctctgatatacccaggagactgatgggggatgggggagtccggtgctgaggtaatagcccaatatggggattccaggggctccatttctgttcactttggggatgggcagttcttcatctgggcagattccttagattgttgttgctgttgctgcctctggacaacgtcctggtcacaacaaggaatctctcctgtgggctgacaccaccttctgccccctccccagttaaggaaaagagagagcagccactcatgggagctcagcattagcaggctcaactcctgacggcgccagagcctcccctataaactctgaagctatgcgctggaggccaccggcagcccacggactccaagttagcttgggagacacgaaaagcaatatatttgctggagcacgtgaaggaacatgggaatcggaaagccaggaagccctgcactctatgtgagcagagccaagggcatccataggagagggagagaaaagagggaccacctcctcatctcatcctggagggcgatagaagaggactcgcgtgtgacctcaggccccaaaggtccctatgtttcttgtaggtgcctaggtccctatttttgcgagcaggacaaggctggggaatggggtggaggtggttgcacttaaggcagaggtcgagtgtgaaatgaatatgcagatttgggaccctcagggagtctgccctgccggaaataggggctccacggagctgagaggatagagtatgaagcagtgagtgctggtgtgtcgaggagaagcacagggctcgatgggcgggagagaggagagagtgctgtgaccagtcaattcacaacttcattgactgggacagggagcctcggagatatcatagaccctagggtttcaaactcgtctctgggctgtgttgtaccagaaatggctccggttgaaggtcccatggaggggtattggggttctgattatgttggcagttgatggtccactccgtggggacaaagggggttcagtctgaggccccaaggaaggagtggtagccaggcactacaagaagtgttccctgggctgccatgccaagaatctggcgtgaagtgcttctctttctagaaacaggctctcagctactccctggcttattgcccctgctccactcatgaccccaccatttgaccttataaccaccagcccactgccctcctggagccacgtacagctgctggtggagggtgtggagctcagtctcctgggctctgcccagtctcccttccctcctccccacagcattcaacatttaccttaagcctcagcctcctttaccctcctggccaaaaggagactgggagggcccttctgcctctaactctttttatttgagacagagtcttgctctgtctcccaggctggagtgctgtggcacgatatcggctcatcacaacctccacctcccaggttcaagcgattcttctgcctcagcctcccaactagctggtattataggcaaacgccattgtgcctggctaatttttgtagttttagtagagacggggtttcaccgtgttggccaggctggtcttgaactcctaacctcaggtgatccacccgcctcagcctcccaaagagttgggattacaggtgtgagccaccgtgccaggcctcagcttctgaccttttagcttaagaaaaactgggtcaggagcaaagactcaagagggccactccttgcatccttctggggcatctctgggcccctggcagcaatctcagtctctccagagccaagagggaccacttgtgcacccccagacaggtggcagctccactcaggcccccaaagccaaagaggcccccaacattctccagcttgcatagagtttaacccttaattcctccctaaatctactcctgggtgatatctacccttctcatctagtacagattcgaatattgttccatttcctgttcacgttttttggttttactctataaacacttgttgagtgatttgtccaaagacacagattatgctgctatttctttctattaccagggggagtagaaaaatgaataaatcctatccataccactacttccctttcactggagtgagcttggatgttcagtatagaccactgctttcactgctttgaaaacctattttgtgactcattccctttcatcctcgccccctcccctttttttttaaactctgacactggcttttagtttattcaagaaatatgcattcttcctaattggatacctgggcattcagatcagatgaatagagttacctaaaaggcttttagagaattttgtgtcggatagccttcatttaaagatatgggcttattttcttcctttctgccttcattctcattggtcgctaagagatgagaaattgctatttcatcttgtcagaagaaaccagtctctgagtgcccttttacacaatctccccgcttcctggcatcttgtccctccgtttccatgacatcccccctcacagttcccgcttcctgaccttttgatgcccacttctcggtctcctttgctgaatcttcttcttcttcttcctgatccttccataataatgatacaataaacatcattaaaatttttattttttttgagacacagtctcgctctgttgcccacgctggagtgcagtggtgcaatcacagctcactgcagccttgaccttcccggctcaagcaattctcccatctcccaaataactgggaccacaggtgcatgctaccatgcccggctaattttttaattttcagtagagacagggttttgccatgtttcccaagctagaaaattgctatttttaagagcttattgtgtgccaaacatcctgtatcaggctctttgaaggcgttggttccttgaatcctcatcttaaccccatatggtattgccatttttacatattttagatgaggaaataaactggaacattaagcagctcacctagggtcgggcagctagttagtggtagagccaaaggtcacattcctggggactggctccaaagcatataattctttttttttcttttctttttctttttctttctttctttttttttttttttttgagatggggtctcactctgtcgctcaggctggagtgcaatggtgcaatctcggctcactgcaagctccgactcctgggttcacaccattctcctgcctcagcctcccgagcagctgggactacaggcacccgccaccatgcctggctaattttat[195 bp omitted]taggtgttattatctgcatgtgacacgaaacaaaattgaggtttgtaaaaattcaggataataaggcctgcctttccaggtgtgccctttatatgagtgattaacatagggttggtccattgtagactcccacagactctcaagaaatggcagctactggacatctgctgaaatgcattactctgctactgaaggaagggcaggaaaagttaaatgctgtccatgccatgcatacagtgcttattcagtgttaatctgatgatatgacagtctggtttcaggagctacactgagcttggcccctgacaggagtcctttacaattcaggtgaccctgaaatcctgccactgccagagttctcaggggcaggataaaaggaggcagcgagactagctctgggtcttgagttatcatcctggcaggaaatatgtatggatccttagctgcagcagctcattgcagaccagagctgacaacttaggttggcctcacacacattcttcttccagatatgtaacatgttcatcatctccattttacagactaggacattgaggcacacatagttattgtcacttgcctaagattacacagatagtaagggttggggctggaattgaacttcagatctgcctctccccagagccagaagtctttacagttatactataaagtccttcctaatgggtacaatatatctgatcattctatcggttgcatcctgggaaccaatttctaattgccatactcacgaccaaaagcctgcacagtaacatagccttggtctcatttcttttattaaacaagacggaaaaaaaaagatcagtttaggaaagctccttcttagagcctgtaactatcttctcttcatatttatttttatatacaatttctgggataagatactaaaaataacaaactgttgatgaggatgtggacaagcagtctctctcccacactgctggtaggactgaggattgaggcattcttgctggaaggctgaccaggaaatgcatcaaaggttgaaatataaaaatccctggatccaacagctgctgaaattgatgctgagaacatagctggacaagtgtaaaaaatttttatgaacaaagatgtttaccctagtttattttgtgtaatagtggaaaactggaaacaagttaaaagaccataagtaaaacttgggtgaataaattaggcttcatacttgcaagacaacgctctgcatttcaagctctcggtgtgccttcagatcattgagtctaattggaaaaattaaatgtggccgctctaaaaacgggcttaaaaccccaggccatctgtgttctctctgacccccagtgtgctgctccatcagtctggaactcttttcacctggcaaaacccttgtcaaacttcaagtatcctctcatctggcactccctcgggccagcttgccctgaccctgctaaagctcattccccgaatcttaggtagcatttatcattgtgttgtaattgcttgtataactagctgtcttccccactaggcttttatcctcccaagcctagtacaatgttgttggggcatcttgacacagacttcaggcacgttcccacctcaccagtttgcactggttgttctcattgttcctccaaatagccctgtgccttaatcattccccatgttcctgtatttgctcaaatgccatcttctcattgaagctgaccctgaacatcccatttaaaacagcacatctgatcatcagcactccgattctctcttgcctgctctatttttccatcacatgcctttcttctagtatactacataatttactgagttatattgtacattgatgtctctccccaccagactcaacgacagcaggcattctagttaactgcagcatcaccagctcctggaacactccctggaacagagctcattctcagtaaatatttgtggctggaatgaacaaagtgcctggcacacagtaggccctcagtgaatgccagcttttgttactgcctcctacctggaacaagtgctgccagaaaggagacagtcaatgagagaatagtgcacattgctgagccaccacccacctagccgatgaaatcacaaacctggaagacattctatatccattgcttggttttcacttccccagggtatcacttattagatggaccattcactcctagcatggcagaaagtgggaaatgggtttctttgtagcttcatctatgtcacatt[179 bp omitted]gtggcgggcaactgtagtcctagctacgcaggaggccaaggcaggagaatggcatgaacctgggaggcagagcttgcagtgagacgaaattgcgccactgtactccagcctgggcgacagagtgagactccgtctcattaaaaaaaaaaaaaaaaaaaaaaaaaaagagtttcaaatccctaatcatcccaagtgcatttgttttgtaatcccatgggcatttgcaagatgccccaacaacattgtgctagtcataggggatataagcctgataataactcataggtcctgaagctaaactgcccagatctgaagcccagtctcagcatttactagttgtgatcccagtcaaggtatttaccctctctgtgcttcagttgcctctctctaaaatggggacaataacagtacctatcttagagagtagttgtaagaaataagcaagttactatatgtgaaacacatattacaatgtctggaaacaggcaagagctctataaatgttaactatcataagccattagtatttaacaaatatgaatgcctataggcacgagtttgaggaatgaaaaagagggaagtggagacattaaatttatatttttctttacccaactcatgaaatatggggagatcagagacaggttaatatagctaaagagaaccgcggggtcaattcaagcattacacttcctttatcaacccccatttcctggaaagttgcccagtccttccttttctgctccta[136 bp omitted]catggtgaaacctgtctctactaaaaatacaaaaaattagctgggcgtggtggtgggtgcctgtaactccagctacttgggaggctgaggcaggagaattgcttgaacccaggaggtggaggttgcagtgagctgagatcgtgccattgagcttcagcctgggcaacaagagcgaaactccgtctcaaaaaaaaaaaaaacaaaaaacaaaaacctgtcacaaacatgtttgttttgttatttactcatgtgtttaatatccacaacattcgtgttttacatgtcttttctctatcctagaatccaggctctttgagtgctggggctgtgtcttatttgtctttataaaaggatttctttgttagtgctttatttttagaatatgttcacatgcttagagtaaggaaaaccactaaagagagaaagacaaggaattggctaaattccttaaaaatatgaaactacccaggtttggggatagtaactgaccaggagggcttttttttttttttgagacagtgtctcgctctggagcccaggatggagtgcagtggcacgcaatcatggctcactgcagcctcgacttcccaggctcaggtgattctcccacctttgcctcctgagtagctgggaccacgggcatgtgccaccacacccaactaatctttgtatttttggggtagagacagggttttaccatgttgccctggctggtctcaaactcctggactcaagcgacctgtccacctcggcctcccaaagtgctgggattaaaagtgtgagccactgcacccggcccattttatcatttgactggggctttgggaaagtatgaagaggttaagaagggaagttaaggaaaaccatagctagtagtcccaacttcctctataaattttaacacaagacatctccgagagactatgcttaattgggggagtagaatttgttgaagtctccttgcatgtgcctaacttcaattccttttcatgaacattttcaccatctgttgcaatttccctgcagtttactattctctttcaaaaagcagtactatacagagtattccagatgtcatcagatccatatagtgggactaccaccttcttcaatcgaacattggtcaaatggaaataatagtctcgatcacatagtgttgtaaaaattaaatgaaaaatttaaaaaagaaaataactgtcttgaaaaatatgggtatattgggtactctttgctattttccttctattaaggaacaaacaagagtgataataggaccgggcatgcttgctcaggcctgtaatcccagcagtttgggaggccaaggcacacagatcacttgaggtcaggagtttgagaccagtctggccaacatggtgaaaccctgtctctactaaaaaaaaaaaaaaaaaaaaaaaaaaattagtacgactgtaatcctagctacttgggaggctgaggcaggagaatcatttgaacctgggaggcagaggttgcagtgagctgagatcgtgccactgcactccagcctgagtgacagcctaagaccccgtctcaataaaaaaaagataataataaatgattttcaatcactatgtattgaacatgtcaataatatagtaagaattcttaatcccatttaagagaatatcaatgagtctcagcaaaagatagtaacaggactaaggtcatacagtcagtaagtgaatggtaagttgggcggctccaaagcctgtgaactttccatcacatattttaagtaaaaatattgacattgcttagaaaaactgtatcataatggaagattagttcttggggcaggagaaataagcagatatgaatatttgaccaatttcctattcatcaagacaaagctgtttgaaaaactataagtaaaggaacttaaattttactagttggaacatgatagaggttttttttttttttctttttttttgagatggagtcttgctctgtcacccaggctggagtgcagtggagcgatctgggctcactgcaagctctgccttccgggttcacgccattctcctgccttagcctccagagtagctgggactacaggcacctaccacgacgcctggctaattttttgtatctttagtagggacggggtttcaccgtgttagcc[131 bp omitted]ttggctcaggaaaatataatttaaggtagaatcttggggctggttatggtggttcatgcctataatcccagcactttgggaggctgaggcagaaggattgcttgagcccaggagttcaaggccagcctgtgaaatatagtgagacacatctctacaaaaaacttaaaaattagcccggcatggcgatgtatgcctgtgatctcagctacttgtaagggctgaagcgggagaatagcttgagcccaggaggtcaaggctacagtgagccgtgatcatgccactgcactttggtttgggcaacagagtgggaccctgtctcaaaaaaaaaaaaaaagattcttggccaagtgcagtggcttatgattgtaatctcaacactttgggaggtccaggcaggagaattacatgaggccaggagttcgaggttgcagtgaattgtgatggtgtctgagcctgggcaatgagactgtctctaaaaacaaaacaaaacaaaacaaaaaaacaaaaaacagaaaagaaatgtaaattttttccttctctgtgtgccagaatgtttgtaaaactatttcatttattaaattattttaggtttgttacaaaagttgaatatttagagtgtcacaaaattatgtaaaatacagttaatacttaaataatcataaaagtatacagtaaaagaaaaaataaatcataggtaaacactgaatattttgggatatttcttttatttcttttttattttttgaagacagggtctggctctgtcacccaggctggagtgtagtggcaccgtctcagctcactgcaacctctgcctcctgagctcaagccatcctcacaactcagcctcccaagtagctgggactttaggcgtgtgccaccacacctggttaatttttgcatttttagtagagatggggtcttaccatgttgcccaggctgatcttaaactcctggactcaagagatcctcccaccttggcctcccaaggtgctgagattagaggtgtgagccaccatgcccaacctggcatatttcttttaaatcttttttctaaccctgtgaatgtagatacatgtataatttactttattgggattgtactctctaaaaagggagttttacatatgaagtatttataaaattgtttttgttctttttctaatgacaaatgtgataattttgagagcaaaattaaagattatttgtcaaaaaagaggagtaaaggggtaaagcctgagcaaatataaaaacatactaataaaaaaactataataaacactgtgttgttactggctgacaaatatccatcataaattgtaataaatatgactcttttcctagaaaaagcaagagaattgatggaaacacagctgaaaataaaacaatgagggacaataacataaaactgaatgacttaggagaagaaaatgatactactcttttgagtgcacctgttagaagatttgaatgaatggagaaaactcaagcttagctggagggtggtaggcctggtggctggggtaaagaggaagatatcaccataaaatcatccaggccccagccacatcataggccaacctcaccattacaatgcagggaccccctgctccaataggcttgccagtatgtga[144 bp omitted]tctactaaaaaatacaaaaagtagccgggtgtggcacgtgtctgtaatcccaggtactcaggaggctgaggcaggagaatcacttgaacatgggaggcggaggttgcagttagccaagatcatgccgctgcactccagcctgggtgacagcgagactccatttcaaaaaaaagaaaaatcgtgcaaatgcttggctaattattccaacaccattaattgaataagtgggaggatcacttgaggccagtagttggagagcaacctgggcaacatagcaagaccccatctttaaaacaataaaaaatcaaatgctcgctccccatatatcaccaatgcacctgatgatatgacgaagtgcatttattgcttccctcactacgggagaacaccacttcgtgaagctttagcggtgcttcagacaggaaaagaaagatcagaatttattgagaaatgaaaaatgggcttaaggcggtgagtctttcaatgctgggatttgattgggattgggtaagaaccacgagataccaacattctaggattggtgtaagcagcaagaggaggattttaatgagaggcattcaaaaaattttagagtgcaaactgttggtgctgtccattgacgagttgatgggcctttgcagaagatcctgtaatgcagaaactattcgcctgcagagaacgtcctggaaaagtaatgcgaatgaagacagtggattagcaaagtcctttttatgtagatgctacagtggggtttttgattctcagtgtccaggccgagtttggggatagatggttttaattcccatatacatacatttttaatggacaattcaccttaggcacgtgtttattttatggtgtcaaaatcctttcatttctcgaaggtgtttactgagacctgagttagttgctaaactagctggtttaaagctaaacaagtagcttaaacctgtctgctaaaaccttcaggtggattatttcatttgctcctcacaaacacctgtgaatcctcacaaacacttcaccattattgtccctattttatagaagaggagaatgagactcagaagtaataattagctcacaatctcggggctacaaatacatgttttcaggagcatcagcaaaaccctcttaatcaaacaaacaaacataaactccaaaaccctgccttattcttctgtttttgcacaaggagctggaatccaggttcaagataattatctggccattctgtcttcttagaggtccttttccctttcgggggaagggaggaaagggtggaagcggcttccacccactccagttcgggcttgggtcagctccctgggcttcgcggagcacgccctggtgccaccggcggggccatttccgccgcgggggcccagacagcgccgccggctcgcgtagggtccagcggaccggcaggctcgccctcgcggtgccagctctgctctcttctggtcaccagggggcgccagaagcaatggtgcatcccgaaagggacggcggccacgtgacaggggggtcacgcgcagggtcgtaggggaccgcctggggatccccggacggctgcgaggaatgagcggttggctcgggctggtttcctccctccaccgcctgcttgtttcgccatgcccgggccggacggtggggctgcagcggcgaaagcgactgaagtccgggagcagtcgcatgagcttcccggtcaccaggaggccccgggaacagacacctcaccctgacattgtggcaggtttggcccttcccgcaatgcaacaaaggagggactttgtcccagcctttcccctagccaggagaggtgctgttaaatccctttgtgcctccccaccggccttggagagatgagatttcccctgtagtaccccaggggacgggccgacgggatggactttgtatcttttggctgatctggccggacatccttgcccaataagcacttacccagttgcccaccctccaaaaaaaggagaaaatcaaatcagtaatttgatcgatcattttcatagatatgctgtaatagaacaattcacctggttgtgaactgggctggggagtttcaagacgtgagtttgttaactgactagtttcttgcttggtgtagaggccttaggcactctcacacttaaaccagcagaaaggccagggagtatctagactacacactggggtcactcaactggaaacacgttgtacacctcaagacatcgtacaatttctcagactgagatgctggctgtgatgtctatgcagcacagccccaagtcccaactgacagaaatgtctcagaaacttaattcaccacggtctttttttttttttttttgagacagagtcttgctctgtcgcccaggctggagtgcaatggcgcgatctcggctcactgcaacctctgtctcctgggttcaagcaattctcccgcctcagcctcctgagtagctgggattacaggcgcccgccacgacacccggctagtttttgtattttttagtagatatggggtttcaccatgttcgccaggctagtcttgaactcctgacctcaagtaatccgcccatcttggcctctcaaagtgctgggattacaggcgtgagccacatgcctggcctcaccacggttttatttttgtttttgtttttttttgtttttgtttttgttttttcttgagacggtctcactctgtcgcccaggctggagtgcagtggcacgatctcggctcactgcaacctctgcctcctgggttcaatcagttctcctgtctcc[217 bp omitted]ggaaaaacagttaatttataaagaaactgaataatgtaataaattgaggaattttttcccagccttgtactttttataccatcaaatccactgactttaagtgtacagtttaaaaaataaatttagccaggagcggtagtgcacacctgtagtcccagctacttgggggctgaggtgggaggatcacttgagccagggaggttgaggctgcagtgagctgtgattgtgccactgcactccagtctgggtgacagagcaagaccctgtctcaaaactaaacaaataaataaaaataaatttatggagttgtgcaaccatcaccacaatacagttttaggacattttccctatcccccacgaattcccagaagcagtttgcagttaatctcctctctcatgtttagccctaggcaaccatttgtctgctttctgtctgtatatagttgctttttctggacatttcacatgaatggactcatacaatatgtggccttttgtgtctgggttctttcacttaacatgatgttttcaaggttcatccattttgtaacattatcaatactcccttcctttttctggctaaataatattacattgatggatataccatattttgtttttccactcatcagttgataaacatttgagttgtttccactttttggttgttatgaataattctgtgaatattcgtatacaagtttttgtgtggacatgttttgggttctcttgggtatatacctaggagtggaattgctgggttttataaagtaactgtatgtttaactttttaggaacttctggattgctttccaaagtggctgcactgttttctatccccactggtaaatgtatgaggatttctatttctccacatccttaccaatactttcttgtctgtctttttgattagtgtctcattgtgatgttaatttgcctagattgagtgacttttggttgtatttggtttagctagtttcacttcatttaatgaatgccttttttagtgttataaaaattaggagctgaaatgaataatacatagtccttccttgcaaggagctcatagttccttcaggaagacagacaacaaaacaatgacagtatagcttgttaagtgctctgaagggagttgaggacaagatgctctggggagcagagaagaggaacacttaaccctgcttgaaggcgggtggaggaaagtattaaggaaaccttttacagaagaggaacacttaaccctgcttgaaggcgggtggaggaaagtattaaggaaaccttttccagaagaggacttaatgtgcctctcgttttcttttgtttattttaatcaaaattatacaagtacatactgtaggttttttatttgttttgaaacagcatctcgctctgtcacccaggttggagtacagtggcgcgtgcaatcacagctcactgcagcctcaaccttcaagcaatcttctcacctcagcctcccaaatacctgggactacaggtgcacaccaccatggc[136 bp omitted]catggcgaaacctcatctctactaaaaatacaaaaattagctgggcgtggtggcatgcacctgtaatcccagctactcaggaggctgaggcaggagaatcgtttgaacccaggaggtggaggttgcaatgagctgagatcgcatcactgcattccagcctgggtgacagagcaagactccatctcaaaaaaaaaaaaaaaaaaagaaaaagacaaaaaaaagacagggttttgccatgttgcccaggctgatcttgaactcctaggctcaagcgatcctcccatctcagcctcccaaagtgctaggattacaggtatcatactgtagtttttaaaaatcaaatagttctacaagatttgctttttttaaaaaatgaatcatttgctttccttcccattccatgttgcccccaaaagcaaccactttctattcttttaagtctttgaatatttacctgtatatctttaaagagcatatttatatttgagaaaaagaagccccaacataggccaattaatatcctcacttgcactgatttttaaattggtcagccctattaaatattaacacatagttagttatgaaagtgacggtcacaatgcagcctaccttctgtccatctaaatgaaagaagacaggcatgctcaacagttagctactagaataac[136 bp omitted]gcgaaacaccatctctactaaaaatacaaaaagtagccaggcgtgtgcctgtagtcccagctacttgggaggctgaggcaggagaatcgcttgaacctgggaggtggaggttgcagtgagctgagatcacaccactgcactccagcctgggcgacaaaaaaaaaaaaaaaaaagtggctgaggaattgtttttctcattggtgctttactatcatatagctccaataagccagcacccaaatgtaactgtcaattatgaggaatgttattttcacttaaactttaaaagaaaagcaaaccacaaacaagctgcatgatgtagtataggaattagcaatctatgacctgtgagctaagaatgtgttttcagatgaatagtgacaacaaatttgatgatagggaacactaattttcaaccctaatgaagcaaaatattatttttctattctaaccttttcattagtagaactgtattataaaaccttatagtcaattgttattactttttaaatttcattaattaaaaatttgtacaattttgttttctctcattatgtaaatacttatataatatcctcgatcttgcttcttggttcataaattctaaattattaattctctgaccttcacagaaaagcttgctaactcctggtttaatagaataaaaagggctgggcgcggtgactcacgcctgtaatcctagcactttgggaggctgaggtgggcggatcacgaggtcaagagattgagaccatcctggccaacatggtgatcaaaagatcgagaccatcctggccaacatggtgaaaccccgtctctgctaaaaatacaaaaattagctgggcatggtggcgtgcacctgtagtcccagctacttaggagactgaggcaggagaattgcttgaacccgggaggcagaggttgcagtgagctgagattgtaccactcgcagtgagctgagattgtaccactctaccccagcctggcaacagaacgagactccatctcaaaaaaaaaaaaaaaaaaaaaaaggtatggaaagcaattgacatgtacttgctgtgtgaccttgggaagtcactttatgtctctggtctttatttttattatctataaaatggagctaaagggtaatgggttgatgagataaactctaccatgaatcccccagtttttgattaattaattatacaagtatttattgagttactgttatgtaccaagaactgttaaatgcattgggaatacagcatgaaacaaaatttttgtcctgaaagaagacactgttctcaatgaaaagagacttaagatgcagtgtgtggtctgagattggatcatgatttaaacaaacttgcttaatgggacatttttgggaaaattagggaaatttgtatatggatggttattagatgatgtgaaaactttttaagatgaaatggtggaggtcattaactgaaaagggcagttgtaaaacattttgtacagtatttcatttttggaagaaaatgcgtatatgtattacatatacttagaaaaaatatctgaaaagatatatactaagctgttaatggtgatttctgtgtgatgggaacacaatgttctatttagttatttttgctttcaaatttttcacaatgaatatacactgcttttgtaaaaataaaagattgtttctaatttaaaaaataatctctcttttcacaaagcttatagctaatgcctcttgtaagtattcatattgccaatttgtcacttttttttttttcagggcaggaaaacatctaagaaaggaggctccccccttcccttgcaggtaacaaagtatcggggtgatctctgtgaaatagctactgaatgtaaactgatgctactggcattcctctgggacttttactgataagtagagctttcatagtcttcccaatttcagatgactcgagattgaatttctttttctttccttccttccttccttccttccttccttccttcct[137 bp omitted]tgcctcagcctcccgagtagctaggattataggcacccaccatcgtgcctggataatttttgtatttttagtagagatgaggtttcaccatgttggccaggctggtcttgaactcctgacctcaggtgatctgcccgccttggcctcccaaagtgttgggattacaggcatgagccactgcacctggtctagattggatttcttatcttgcaaagccaaggtgaagtccagaccatgaaaaagcagaaaatgtatcaagataaatactaccttgtgagccctatcaatagtcctaccaatagctttctgatattggaggctttcaaatgagattttttttttttagggttaccagcaattaaaaagaagtactagagaggcaaatatcggcagtatacatctaagcgctggtcggaaaagaaggaactcagcccaagaacttgcccaatctgatactggaggtaggtgtatctctgttgcatccatgaacgcatcaggctaccaaagcccgatgtgattaagcatttgaatcgtgtaactgcttctcttattgtaggccaggagtcagcaaacttcagcatgtggaccaaatctggtctgccatctatttttgtaaataaagttttattgtttatttgtttatgtattgtctattactgcttttaccctgtgatggcagagttgagtagttggcaacagatactgtatatgacctacaaagccacaaatatttactatctgtccatttatttatttatttattcattcattcattcatgagacaaggtctcgctctgtcacccaggctggagtgcagtggagtgatcacggctcactgcagccttgaactcctgggctcaagcaatctacccacctcatcctcccaagtagctgggactacaggtgcgccccaccatgctcagctaattttaaaatattttgtagagatggggtcttactgtatttcccaggctggtctcaaactcctgggctcaagcgatccacccgcctcagcctcccaaagtgctgggattacaggtgtgagccaccatgcccagcctatatggccctttaaataaaaagtttgtggacccttcttctagattcaccagaaaactgcctcagtacgcatgcctgtgggagagaataaccacttatattattttcttttttttccctatacatttaagtagtgttcctttcatccaacggaaaatgaagaaagggactttctttggtccctgcctgtgttcacctttgccaaggacctttctctcatgaatccctctctgctcttttcaaggagggtttcaggttctgtgttatcacccaaattgtgacctttacaaagccccgctggtctgcttggaatttcacatgatgtgcccttctctagatttaggtctttacatgtagtacttgcttatttaaattttatttgcctttcaaggtgccactcaagaaccactccctccaagatgttttcctggatttcctcagcctaaagtaatccctctttttcctgggtgagttatatcttttagtttatttctcttgttaggctcacgttcactgatttacatccatactcattgctttgtgcttatttgtatttgtgagttacattctctaccagattttaaattccttgagggtaggtacatatgttgttcaactttttttttttttttttgagacagattctcgctctgttgcccaggctggagtgcagtgcacgatctcagctcactgcaacctccactccccgggttcaaacaattctcgtgcctcagccccccgagtagctgggattatgggtgcatgtcaccacgcctggctaatttttttttaacagtttcttcatgttggccaggctggtctcaaactcctgacctcaagtgatctgcccgccttggcctcccaagatgctgggattacaggtgtgagccactgcgcccggccttttgttcaactttaaataaattattttttccccatcatcagatgcaaaagaggttcaacaataaaataaattggtaagttcccccatatacttcagatctaatctttagttctccaatgtttccactgaggatttttcctgtgaaatgctggagtcacttcctttgtccgtagtgatccttgtaatttcaagcaccaggctatgattttctattccattgctttgatggagttacttccactagggggagctccttactttgctatatagtcaatttccttctctttaggagacaaaagaagggagacttcctcagacaaaatgtcaaaacaatggtaggaagtagcaactaaaaacatctcctggggcttgactaggtctcagcactagctggctcctcaaatgccatttcacttgtcatattgcaatttggtataattctggcccatgtgtcaagatttccccctacccaatctacttcattcattccatttacaaatacatattgagtacatactttgtgtcaggtattgctgtagatgctggggcttcatctgtgaataaaacagaccaagtccctgactttatggagcttatattcacatatgggcagcggacaataagtgagatgaataaagaaaatatacagtctagtagatagtctagtagatagatatttatctagtagataaatataaaagaaaaaagcaatgcagcatcttgtaggctattgtgagaattttgaatgtgatgggaagcattggggaattttgagtaggggagtgatgtgatctgacttacattttataaggattgctgtggttgttttgtggaaagtaattttttttttttttgagacggagtttcgctctgttgcccaggctggagtgcagtggtgcgatcttggctcactgcaagctccacctcccgggttcacgccattctcctgcctc[134 bp omitted]ggcctcccaaagtgctgggattgcaggcgtgagccaccgcgcccagcctgtggaaagtaaattttaagggggcaagcttgggtcaggggaggaacagtggacttggggagaagttgttggattttggatacattttgaaggtagagccaactggatttgctaacagatcagatgtaggatgtaagaggaatcaaggaaagcagggtcaccatatggcataacactaatagcattgacaaaaatgtgactggtgccccctggagttctgtaacacagcatctctgtccaagatgatgccaagtcttttggcctgaatggtcggaaagatagagttgccactaactgcaatggtgaagactgtcagatgaacagggttgggagtgtgttggaagctcaattttggatatgtttaatttgagctgccagttagacatctaagtggggatgttgaataagctgtgggatgtatgaacctggcattcagaggagtggcctgggccaaagataaacatttttgagtcgtaggcatctacatagtatttaaggtatgatatggacgaaatcaccaaggagtgagaagggttaaagagaaggagaccaaggaccaagccctgagacatctcaacatttagagtttaggaacgtaaagaggaacaaataatggaggctaagaaagactggccagaaggtagaaggcaaaccagaagagaatggtatcctggaagccaagtgaagaaggtgcttcaaagaagagagaatgatcaactgtgaaaaatacttatggttggccaagtaagctgaggtctgggaagttttggtagaatttaacaacttagaggtcactagtagccttgataaaagctgtttcagtggacaaaagcttgattagaatggttcaaaagggaaagagaagagaaaaattgtagacagggagtatagacaaatcttttgaagatttttgttttaaaggtgagcagagaaatgaggcagtaactcaaatggtttgtggggtcaagagagggtgttttgagtgggagaaataattgcaagtttgctctaggagtacttagcgacagttgagttcacttgtacttattcacctgcatttcttgggggtagtacccagtaatcctcagggaaggtagctatcacaggaggggatgttgccaataggtttgagtggaatgaactctaagggaacccatggatgccctttaataaaactgaattcagaacctctgcagttagcagagcagagagtatcttaatgtatggaaaaaatcagggctgtgaggtctagctatccctctcacccacatggtgattccagcctcctttgccaaccttgaaagatctggcctcaagttacactaaagagagtctgagggtctccttccagaaacattatctattgtatggaagggagaggaaaggaagttcttacaggtgctgtgaagctgactaaaaccccagggagtgtttcaactaagtgggaaacttgacataaagattcactggtcatttcccggttccttggtgagaagtggcctcagcagtagaagacagtatagcactgggcttgtttcttagctttgtactttagtagtgatggctttgaaaacacatacaagttttactggtctccatgtagcattttggtttgaatttttttaaattacttttatgtttttgagacacagtctcactctgtcacccaggctggagtgcagtggtgtgatcttggctcgctgcaacctccacctcccgaattcaagcagttctcctgcctcagcttcccgagtagctgggactacaggcacctgctaccacgcctggctgagttttgtatttttagtagagatgggattttaccatgttggccaggctggtctcaaactcctgacctcaagcaacctgcctgcctcagcctcccaaagtgctgggattacaggtgtgagccactgtgcctggcctgaatttctttcctattctcataccttcaaggcccagctcatatgttacctgctctacagagccttctttgagctccctctctggcaaaaataatcatttcctctctgcatctatagtattttttctctttctttctcttagcacatatcacattgcgttatggttgtgtggttgtaaactgatgaggcagtagagtgtaatgatgagagcatgggttctggagctaggctgcttgtattcaaatggtggctcttgcaagttgcttaacctccctgagcctcagtttcttatctgtctcatctcagtttaataataacaatatgactgggatctcataatagggattttgtaaagattaaagagattaacaatgtgaagtacttagaacagtgcccagcacatagtaagtgcttagtgacctttcgttatttgtttctcttcttgctga[356 bp omitted]tattatactttaagttctagagtacatgtgcacaatgtgcaggtttgttacatatgtatacatgtgccatgttggtgtgctgcacccattaactcgtcatttacattaggtacatctcctaaagctatccctccccctccccacaccccacaaaaggccccggtgtgtgatgttccctttcctgtgtctaagtgttctcattgttcaatataaacagaaccaaataccatatttttatctttgtaccactgatgcttagcactgggcttggcagagagtactgggtatctacttaatcaatttttgtgtgaataaaccagatttctaaatcaacttcagttcttctttaatagtttcataggtatatagcccttttatgagatcactcattcattcctgtgtaccactctgtgtagtagttaagaatgaaggttctggagcctgatcacccagtttgtattgttgttttgccagttattggctggatgagattaggcatgatatttaacatctcagtgcctcagctctctcacctggaaaatgaggagaaatataggacgttaaacatagagtttctgaacactcaaaagttaactataagtattattaatcttatcagcaattaagcgacttaatgaacacctacaatgttccaggaattgtgctaacagtggggatgcagagatgaataaggcttggtccctgctctcagaaatcctataagctagtgaaggaaacaagtgtgatcaaatcagtatgtatggagcctagcagaagatgggatcaatttaacaggagggaacagtaacaggaaaaggcagggtagtaagactttatagaggagggaattcctgagctttgcatctgtgggttgacagtcctgggatattaatgtcaagtacatattgaaatcccttttgtggtttatcagagatgagttttataacagatttctcccatcagattttcttttttgtttgtttgtttttgtttcactgaaagcatttacctggaagattttcttaataaggccacttaacaagaggcctccagacggtgatgatctctgtcctcacttggcagcatggtgactgcactgccatgcagctcctccgtctcaccttgccttttgagagatctggctggttttaggagcactgttactggattcaacattgcatctagacttgagaattctttgttcacatctggtttgaaaaagaatgtttgaatggcttctgtctgtcctgtttgcttggaaacagaaacagggctaattgttttatggaaccctcaatctgctatttgaatgaattttatgataaatgcatataaccaagaccagtattgatattgccttctagtttgggggcctaagaaaaattttaatccttctcagaaaatatggaattgtcatgtcaataaatcttgtccaatgcctaaagaaaaagcctcaccctggctgggtgtggtggctcacgcctgtattcccagcactttgggaggc[137 bp omitted]aggaggctgaggcagagaactgcttgaacccgggaggcggaggttgcagtgagctgagatcacgccattgcactccagcctgggtgacagagtgagactccgtctcaaaaaaaaaaaagcttcaccctgccttttgaatcccagagaacctgttctgggccaacaatgcaccaccaggctttcccaagtgcaccaaacatagttttgaatagttttccttgggcaaagctcctctttccttttgaacttcagccagagggccctcacaggcagaagactaaatttcagatgcttctgtcttgccctctccctccctctcaataaattttctgaaaaagttggcatttggattcttcttttcccaccctaacaatcaggcaggaaggaagtagagaatagcatatgttctaagaaaaggctggtgcccctttctagctcacccttttaatagaggcctcttagagatggtgggactggagctacaattaaatttttgagatcaaagacagggtgcagatagatgaaaatcttaatgtcttttgtctctcagaaaaccaatagagccatcgaagcttgtctagttcccccaagtagttaatgagaacaatagaattttgagttcctggtgttctttggagctgattttggcaaatgacaagcagtttgtaaaagggcttattattcgagtagagctttggctgcctgacttttaaggttgattatttgttttgcatgttgtataacaggagtgttgggcaatgctcagaagaggtttttggggtcagagatgtaaggacttctctgactgtcttctcccaacagaaccagattccagctgcggagcaagaggcaagcttgtacacaggaccaaagccatggcttttgtatagccccttaccaccagacaggccttttcactggttcctttagggggagaatatatcaaaatttctatcaagtcagtaacccaagaaaaatatttctctgtgtatgtaatttctcaaactttcattggtgatgtgacctgctttttaaagaaacatttttaaggacatagtttggtcttttgcaataaacagttgtatatggggtccctgtcagctcagtaagtagatgctctgaaaggtagagccttcaactggttatagtgaaaaacagctaagagaggtcttccctcattggtgaagagtgccaagtggatgttgtcccagcccttttgttttcaaggtttaaagtgttgtgcttcctgaccaggtgcagtggctcacacctgtaatcccagagctttgggagaatgaggcaggtggatcacttgaggtcaggagttcgagaccagcctggacaacatggcaaaaccctgtctccaccaaaaatacaaaaaaaaaattagccaggcgtggtggtgcacgcctgtaatcccagctactggggaggctaaggcaggagaatctcttgaacccgggggacggaggttgcagtgaatggaaatcgtgccactgcactccagtctgggtgacagagtgagactctgtctcaaaaaataaaaataaaaaaataaatgaaatgttgtgcttcctatcttatgctggacctgctggctcactgagagatagagaggcaaatattagacattttggagacagtgaatgaaggatgttcctctccctcctattctaaactttaaaagtacactgagccagggcctacaagaaattgagattttttttttttttttgagatggaatcttgctatgttgccaaagctggacttgaatttcaaacaatcctcctgcttcagcctcccaagtagctgggactacaggtgcttgccactatcagatggctttgataaacagaaacttagttgtgtctccttttttgttttttaatgggaacctaatatatgagggagttctgtgtataaaggctataaactagcatttgtgtccagtgccatcagtaaaatgggaagtagcagaaggagatgataggtacctaggaagagatttcatgagctattcaataaattttggatgctttttgatatttggaagatgtgtgtccttaggagagatggcctctacacttgaagttactaattcatggcaaaccattctccttcaaagacaaagttttgctgaagagagtcttgggaaacatgaaatctgatcatcctggtagagtttgtgtctctaaaaggaactatacattgtgggtgtgagtagcttaatttcttgcactaaagtctctggcaccctaaatgaaacactgctttggtgcctatattaatcacgataggctagaccgatacagtgacaaatagcagaggtttatttgttgctcacataatgtttgatatagactggttggtcctcttctgtcttgtagctataccatctggaacagatgacttccaaggacaccgtagcaaagaaaaagagaactggaagcccatgtgccttaatcgcttcatcctagaggtaacacagaacttctgcatacatttcattggcaggaactaatcacctaaccccaatttaaccacaaggaagactgggatatgtagaggcatagctagtagatttcacgtctattaacagtctctgctataccccctcagtaccaactgaccactaacttcccaccccactcaccaggaatgtatagctgctgatgattttcgaattcggtaagagactggattgtgaatatcagaccacctcttcagtctaacagacagtgcttgttttacctaaggtgaggagacagcacaggcagtactcacttgtttgtcagttacagtccttttcctctccctctctcattactcaccatgaaacacacattgtcccttctacttctgtcccaagcgtcacactcataagaacataagaagtgcccccagatcaaacaagagtgcttgaatagaaagtgagatatttcttctttataaggttgaccttacaaggctgaggcaggctatgcctaattatgtagggaccctaatgtctcatggttgtgtcagcataaattaattaatgattaaccctctaacaaggctaagtgaacagaattccccagtgtcctgagagaaggaaagttaatgtgttctttctcccaggaggaggataaccagtggagccttttctggatttctcactagaagtaaagaccaaatttccagaaggaacctgagagataaaaagtggttggctgctcctgacctgactcatagtgtttaactgaaccataccactagtgtatactagtgtgtgtgtatgtacatgcatacacacatgcacacacacattcacacacaatcctatggtatttggtgactttggatgcccagctcttgcaacaatttcctgctgtcattcttttccctttgaatctcaggggtgagcaaactaaagaaatactatcatcttactgcttttagtatattccatagaaaaggagtggctggagtcagtgtagatcaacccaagcagtacaaatctgccagaattgcagctcagcttccttacctccagcatgtgtacctttctgaagggtaggcccttaagccagacataagtaagttatccactctgtgcataactgtctgacttggcttagaagcatgaaaggggcagaaatgtaagatgggtaaagaagggcttcatctgaaatagggccatgatgattagctctctctttccttcctttggcttcattgctgtattccatgtgggtcttgatatcttgaaactggatgagatacccaaatagtcagtccctgaatataaatcatttccttgtacagaatcactgccaaactcagtatggttaaaagatttttaacacccagctgcagcattcactctggttagaattggccatttaaatttatttcacatatgtaagtatcatatcctttataatgcattcttaattgttgctcagttcttccagattgaattcctttaaaaaattccttatgtaatcttttaattctagttggaaaacatcacttgacagttgctgtttatacaggcatgcctcgttttattgtgcctggctttattgtactttgcagatactgtgtttttcacaaatggaaggtttgtggcaaccctgcgttaagcaagtctgttggcaccattttctcgacagcatgtgctaactttgtctctgtctcacattttggtaattctctcaatgtttcaaactttttcattatgattacatctgttatgtggagctgtgatcagtgatctttgatgttaacattgtaattgttttggggtgccacaactgtgcccagataagacagtgaacttaattggtaaatgttttatgtgttcagactgttccactgactagcccttcttcaaactctctcactctccttgggcctccctattccctgaaatacaacaatattgatattaagccaattaataaccctacaatgatttccaagtgtttaagtgaaaggaaa[135 bp omitted]ggtgaaaccctgtctctactaaaaaatacaaaaaattagccgggcgtagtggcaggcgcctgtagtcccagctacatgggaggctgaggcaggagaatggcgtgaacctgggaggcggagcttgcagtgagccgagatcgcgccactgcattccagcctgggtgacagagcgagactccatctcaaaaaaaaaaaaaaaaaaaaaaaaagctagaaatgactaagctaagctaagtgaggaaggcacgtcaaaagcccagcgaggcctcttgtgccagccagttagccaagttgtgaatgcaaaggaaaagttcttgaaggaaattaaagtgccattccaatgagcatgtgaataagaaagcaaacagccttattgccgatatggagaaagttttagtgatctggatagaagatcaaatgttttcttaagccacgatattcccttaaaccaaagcctgcctaatccagaactggaccctaactctcttcaattctatgaaggctgagagagatgaggaagctgcagaagaaaagtgtgaagctagcagaggttggttcatgaggtttaaggaaagaagctgtctccacaacacaaaagtgcaaagagcagcaagtgctgatggagaagctgcagcaagttatccagaagattaactaagatcattgataagagtagctgcactaaacaacagattttccatgtagacaaaacagccttatattagaagaagatggcatctaggaatttttttttttttgagatagagtctcactctgttgcccaggctggagtacagtggggcggcctcagctcactgcaacctccgcctcctgggttcaggtaattctccctgcgccagcctcccaagtagctgggattacaggcgcccgccaccatgcccagctaatttttgtattttttagtagagatggggtttcgccatgttggtcaggctggtcttgaactcctgaccttaagtgatctgcctgcctcggcatcccaaagtgctgggattacaggcatgagccaccgtgcccggccagcatctaggattttaatagctgcagaggagaagtcagtgcttggcttcaaaggttcaaaggacaggttgactctcttgttaggagctaatgcagctggtgactttaaattgaagccaatattcatttatcattctgaaaattctagggtccttaagaattatgccaaattctgcttgtgttctctaaatggaacaacaaagcctgaatgacagcacatctgtttacagcatggttttctgaacatgttaagcccactgttgagacctactgctcagaaaaaaaggttcctttcaaaatattactgctcattaacaatgcacttagtcacccaagagctctgatggctatgtacaaggagattaatgttgttttcatgtctgctaacacaacatacattctgtagcagatggattaaggagtaatttagaccttcaagtcctatttttttaaaaaatacattttataaggctgcaatggagctattcctttgatagatctgggcaaaggaaattgaaaaccttctggaaaggattcaccattctaaatgacattaagaacactcatggttaataggaggaggtcaaaataccaacgtggactgtaatcccagcattttgggaggccaaggcgggtggatcacttgaggtcaggagttcaagaccagcctggccaacatgctgaaatcctgtctctactaaaaatataaaacattagccgggtgtggtggtgggcgcttgtaatcccagttacttgggaggctgaggcaggagaatctcttgaacccagaaggtggaggttgcagtgagccgagattgtgccactgcactccagcctgggcaacggagtgagactccatctcaaaaaacaaaacaaaacaaaacaaaacaaataaacaaacaaaagacaaaaaaaaacccaacattaacaggagttgggaagaaatttgatatggttcagatctgtgtccccacccaaatctcatgtcgaattgtaattcccagtgttggagctggggcctggaggaaggtggttggataacgggggtggtttctcatggcttaacaccatcccccttagttgccgtcatcacatacttgtgagatctggttgcttaaaaatgtgtatcacctcctccccgctctctttctcctactctggccatgtgaaattacttgctcttccttcgccttctgccatgattggaagcttcctgagacctccccggaggctgatgctgccgtgcttcctgtacagcctgcagtactgtgagccaaataaacctcttttctttatatattacccagtctcaggcatttctttatagcaatgcaagaatggactaatacaaagttcattccaaccttcatggatgactttgaggggttcaagacttcagtggaggaagtcactgcagatgaggtggaaatagcaagagaactaaaattagaagtgaagcccgaagatatgattgaattgctgcaatctcatgataaaacttgaacagatgaggtattgcttcttatggatgagcaaagaaagtggatttttgagatggaatttactcctggtgaagatgctgtgaacattgttgaaatgacaacaaaggatttagaatatgacataaacttagttgataaagcagtggcagggtttgagaggactgactccaattttgaaagaagtttcactgtgggtaaaatgctatcaaatagcatggcatgctataaagaaatcttttgggccaggtgcagtggctcatgcctgtaatcccaacattttgggaggccgaggtgggtggatcacgaggtcaagagattgagaccatcccggctaacatggtgaaaccccatctctattaaaaatacaaaaaaattagctgggcatggtggcacatgcctgtagtcccagctgaggcaggagaatcacttgaaccccggagatggaggctacagtgagccaagattgtgccattgcactctaacttagtgacagagcaagactctgtctaaaaataaataaataaataaataatcttttaggccagtcgtggtggctcacgcctgtaatcctagcactttgggaggctgagacgggcagattgcctgagctcaggagttccagaccagcctgggcaacacagcgaaaccccatctctactaaaatacaaaaatcggctgggcgtggtggcgggcgcctgtaatcccagctattcaggaggctgaggcatgagaattgcatgaaccctggaggcggaagttgcagagagctgagatcttgccactgtactccagcctgtgaaactctgtctaaaaaaaaagaaaagaaagaaagaaggaaagaagaaagaaagaaagaaagaaagaaagaaagaaagaaagaaagaaagaaggaaagaaagaaggaaagaaggaaagaaagaaagaaagaaagaaagaaagaaagaaagaaagaaagaaagaaagaaagaaagaaatctatcttttggaaaggaagagtcaattgatgtggcaaacctcactgttgtcttattttaagaaattgccccagccaccctaaccttcagcaaccaccaccctgatcaggcaggagccatcaacctcaagtcaagacctcccaccagcaaaaagattatgacttgctgaaggctcagatgatcattagtattttttagcaataaagtatcttaaattaaggcatgtttattgtttttataggcacaatgctattgcacaattagtacactatagtatagtgtaaacatgacttttatatgcactgggaaaccaaaaaaattgtgtgactcactttattacgatattcactttattacagtggtctggaacccaacccacaataccttcaaggtatgcctgtatttcccctttctttcccagtaacaaaattttaattcttcaatttcacattttcccgtcttcctcttcctattttgatctctgctgttggttgccactttctttgctaagtttcctttcctttcccaacatcaaatcctaagttttattcccttttctgtatatttaatttcagttattttgtgcgatttctagcacaacttttaagtaactgaagatatataactctgagccagttagaatcccttagacttatgtgatccttccaaggagttcaaagtaattcaccttaaaaattaaactattccactgtagtacttcatttatcatctccagatatctggagactaggtaggggcgacttttacccttcctattttaagaatggacaaatcgagatttcgagatgataaataacttttccatcatcattatcctgctggttctttgatgtccagaccaaagtaatgaaatgatgacctgtgaattctacattattacctccttccttgattaaaaatgacactgggacaggctgagggagactgctgtgcattgtatgggagtgaataatctggcagaggcagaactctatagttaggcatccctaaaaggcagggaccccagcatctaaacaatcctcctttgatatcctgtgtctggctgggcctttggcatctggcccagcgctcccagcagaaccctgtggtaatccttgcctacagagtatggggatgcagtgagcatttagctgccaagaatgttatagacaatagaaatagagaagtttcaagtgttccttcctagagtagcaagtgacagcttaggatgggagggagaatggccttctctatagcttaccaaatgagttagtgactatgaaagtggtttctaagtagtaaaaatatggaacacacgatggttattgctgtgacattataaattgcctgtgttgtttttcccccaaggtttgtaagaagaccacagagatctcaaatattgctacagtcatgagctcagcctcctgagtagctgggattacaggtgcccgccaccacatctagctaatttttgtatttttaatagaagtaacacttacagttcccctaggcacaatgcagagattctcctctgtggaagttagagcaaattccccaggctagtgttacccctgctttgtcagcacttacttcattttctgaaagaagaatctggcgtggcttcatctttattcctaattgttcttcccaattttctgtcattcaaagccttctgagctctagggagttgagtggaggacaggggagcttgaggcatggcctgatcccaggcttatattccatagtacagcatttatccccaggtcgggcctctggcatcctctgctctctgaaaatctgctccaaatctggatggaagaaacagtcgcaaactccctcaaacacacagaggtagccttacagcattaaaggtctgttattcttcagacattttctagtcccttgtttataacgtagctctaaagagtcctgtaatctggttacctagctgcacagattagaagcaacaggcagatatattgcagtgggggagggagggaagaagctcagacaaactgatggaggaagtgcctgctgaaggcctgaaaccctgggaggaggcaggaaaacaaaatagcataacgtaatgaaggatgtgattgtgattaccctgagtaagctggaaaaaggttcaagtgggctggggaatctggaaaacatgttatataaacatgtatatttcacatgtcatgaaaatactgtttaaaatttttggcatttaagggataaggttcccttatctatacaaatccagttatttctaagtctgccataactcacctaaaccagaattatgagtatttcctatagtgacaatataatgcttttttatagtaaggatttgaagccctgtttttgtgagtgtgattcaggcatcgtgtgagaatgtgattggaatgctgaattcattcattccctgatttggtacgcatatagaagtgttagccaggtgcggtggctcacgcctgtaatcctagcactttggaaggctgaggtgggcagattgcctgtgctcaggagttcgagaccagcctgggcaacatggtgaaactccgtctttactaaaatacaaaaaattagctgggtgtggtggcgctcgcctgtagtcccagctactcaggaggctgaggcacgagaattgcttgaccctgagaggcagagaggttgcagtgagccgagattgcgccactgcactccagcctgggtggcacagcaaaactctgagtccaaaaaacaaacaaaaaaaagtgtcacatttcagccttcatacaaggctctctcaaccgcccttagacttttcctcacatttctttcattggcccaggagttgcttttgatcctccatggaagcctgagctgtggaagactgcatctcaggactggaggtcccaaacaggaagtgacttcaatcttcaggaaagtcactgcctggttgtcacctggattcacgttcagtgtaccgatgaactaactagcccagtgcatttgtcactgcttctgagtcaagcctgggcagggcacagaggctggtgtacagattctaccttgtgaactgtcctgctcgcaaggccataagctttctgaacagctgctgtgaactggcaggtgctgggtgggaggtgatgctggttgtgccagagctttctggtgctgtcatatgcttctacaattacctcccttcttttgcttgcagattcatagtttggccacacatctttgccagcaggaaggtctgttttattcactcctctcactgaccctccccccacccccagtccatgacagagagtatgattgacttggctcaaagcaaagaagcagcaaggctgcagagcccataaagcagtcagaaacatgtctcacttagctcttgtaattgtgatgtcttggcttggccttttgccacccttccctgttctggtccttaacatgcttcaccgaggggtagttgctaattgggaaatttagtgcatccttctttgaggatgattgttatggctatagaactgcaaaataggacactaagatgtggtggagcactggacttagaatcaggaagcctggtcctgattctaatcatattctggtcctgggtcagctgtggattgctgtgtgatcttggacaaatctcttcctcatctgctggaggggcaaggggacaatggttatactagtcaatctctgagatctaagcattaaatcttccattttctttcctgttcatgcagaaagaaatgttttggttcatttcctagaatgtcttctctttttctctgtatccacgtctcctttcaccagaacctgtcttttggtgaagcaattactcatctatttcattttaaagcttccctgggaatatggaaagattgtatagaggtgcctaggttctaggagtttttattttgaaaccgatgtatggaattcaagattaatagagttattgtagtcccatctggaattttaatcactgaatcacagggagagcagccaagccaaccatccatgatgcagttagatttggaactagacatctcagcctcagttctctcctgcaagtgactggggtgggagcagaaggaatatgctatcccatcacctcccatcattagcactgcccagaaaaagcagaggagagactgaaaagggtgtggtagcaaacttggacaaggataccagacaagtggcagactttatgaaatgtccactgtttggcaaatgagccaggcattgtggagcagggagactaaggacaactttctacaaacaaaccctgcctgttcttgcttttgggcctatatcaagttttctccaattggcatgccctccttttcctcgtagcttattcaaagtcctacccatccagcaaactccacctcttctatttaagttcagcagacctttattgaggaccacccaatgacccagccctcctttaaggatacaaagatgaataaaaacttagtgcctggccttgggatgacagtaatatattgtcctgcttgggtcactgttgtttcatgtgtgtttcttttccctctgcagctaaactgtaagctcttggagggcaaattgtgttttgaggggtcccgcaatcaccccaagttgggtgatttactagaaagactcataagacccaatagcaggttttacttacagctaaggtttattacgccaaaggatacagaacaaaagctgcaggaaaaatatacattgagtaggcacaggttttcaagtcctttcttatccatggctgcacaggagcatctaacaaattaacagcaaactacagggacacctgtgaaatgtctctgtctaggaaagcccacccaagtctcagagtctctgaggcttttgcgaaatgacactcaggatcccaacatcaaaaccaggtacatcatgaatcttgcaaaaacaatccagagaagtcctgacaagtagatacagtatacctcattgctctggatgtataaaatgacatcaagacatcatcaattggtgacataaagaacatctgagggctgtattcccagaggtaggcctaggggcaatcataattctaggctcccctgaagatgtgcaaggactgatcaattagagcttctgtgttaaccctttcttcaacgctgtgtcttacacatttcatacatcccctcagagtgtttagcacagacaggtcctcttctctaagcccaagactcatatatttcactatctcttatgttcattcccacagacatcagcacctcaacatgtacaaatatgaactagatttccccccttaccccactttctccatctcagtaactgtcaacatcattcactctgttgctcaggcccccaaatctttgttttccttttgattctcctctccccgtcacttcccacaaccaatcaggaattttcttttgactctaactttgaagtatatcccaaatgtgatctctcatcctctcagccaccctagtgtaaaccatcatcatctttcatctggaccacttgcctcctaaatgtttcaatttgtttcctctatagcctgttctccactcaccaccaagagtgatccttcaaaatgtacatcagactatgtcacttctggctactcacaacctccaattgttcgttaatatgcttggaataaaactgaaacattttactctcttgctcacttattgtgctctagcctgagaccccgtgaatgagtatgtttccttctcacatgacattcctttttccaggactgttcttcctctaacgctttaaatgcctggatgcttttcctttaagtgtgaccttcactatcagcccctcatggagactttttctgatcaccctatctaaggtagccctgctcctctgctcacctgaaatcataattgtttatttgtttatgtatttgttgtcactctacactgattagactataaactcatgagagaagacctttgtctctcattcataatgatatcttcagcgcctagcactatgccaaatttagagtaggcttccaataaatatttgttaatgaatataataggttattaataaatatatttgattacttaaaagtgatgaactggcctctgcccttaaaaggtttatgttctactgaagagttgagtaggaaagaaactcaaaatagatggaaaacttttctgtgttgtccgggatccaacataggacatatcagcattctggacagcagaaaccaacaagcaacagagggaccacatcaaacagctggaatctatccagctcagcattctctctggcaggggtttctggggtctgtttgaagagagatacaagaagcttggaaattccatgtggaaagcaaggatcgtggagagttgatgtcttctttagggtagtggcagtggagtttttgccagcgaagcacccacagtatggctgcaccttgtttctggcctcttcagggcctcgctttatgggtcgccagagatcctgtgggtggtctaatattgtttaataaatttcctttctgcttaaactagtcagagtggattttgcagtttgcagttaagaactcagacctatctaataggttgaaaaacaaggttgaacttcagaatggtgacttgtaactgacatctaactttgatagaaagtgttaaaattatactgatgttggaggcattacttcaaaactgaaccaaaacatatagccatatcaaaatgacatgctaagtttgagacaaagcaatttatttagtcacatccatgggaaaaattgtatatgttttcatgtgtctataaagcactattgtcaaaaatgagcatttttaagcatttacttctttaagttgattgctattataatctggtgtaatttttattacaagtatatcagcaactaaatgaaaaacacttaaaatatttttaaaaggcaaaactaaactattacgtttaaggttgcaacctgagcgataaaactataatgaaatcaaggaagagaggaagagatttccataaaagtcagcgtagtggttaattttaggattgggatgggacatgtgccaggcttctaaggtagctagcaaagttctatttcttgacctagaagtaaatatctaaaagtgtatttactttataatactctattaagatatgcatttttctattattatatcttgcagttaaaatggttaaaaatatgtatatcaactactcaaatgtgaattatttttatggaaatgtcccctgtatgttttcatttcaggatccctgaggactttcttacggatttttgtctgtgggaacttgtgaattaccgtatgagcttagcaggagagttaacttaaaatgtttattgtcccttatgactgggcgcggtggctcatgcctgtcatcccagcactttgggaggcagaggcaggccaatcatctgaggacaggagttggagacaagcctggccaacatgctgaaaccctgtctctactaaaaatacaaaaattagccaggtgtggtggcgcacgcctgtaatcccagctactcgggaggctgaggcaagagaattgctcaaacccaggtggcagaggttgcagtgagctgagatcacatcactgcactccagcctgggcaacagagtgagactccgtctcaaaaaaaaaaattaattatcccttataatcaaagttatgcaaatgaaaacaagacaccattattccccatggaactgtcaaagatgttttaaaaagtgttattactcagtgttggtgaaagtatggagaaatggatacttatatatgccctgatggcagaaatgtaaatgactataatctttttttttttttttcttttgacagaggcttggcctgtcacccaggctggagtgcagtggtgcaatcttggatcactgcaatctccgtctcccgggttcaaacgattctcttgcctcagcctcccaagcagctgggattacagacgcctgccaccattcccagctaatttttgtattttttttcagtagagatggggtttcaccatgttggccagactggtcttgaactcctgacctcaggtgatccacccgcctcagcctcccagagtgctgggattacaggtgtgagccgctgcacctgaccgactacaacctttttgtaaagccattttgaagtctgtaacaagggcctaaaaatgctcattttttttttcttttgagacggagtcttgctctgtcaccagactggagtgttggggcacaatctcggctcactgcaacctctgcctcctgggttcaagtgattctccagcctcagcctcccaactagctgggactacaggcttgcaccaccaagcccagctaatttttgtatttttagtagagacagggtttcaccatgttggccaggatggtctcgatttcttgacctcgtgatctgcccacctcagcttcccaaagtgctgggattacaagcgtgagccaccacacctgggcccaaaatgctcatttttaggaaactttaacccagtaaactcaatcctaggaaatttatattaaggaaatagtcagaggtgtacaagaaaatatatgtacagggatgtttcttgcagtagttttgtaatagtaaaattttggaaacaacataaatgtttaaccctagggaaatggtacagtcacaaaacaaaatattatacagccatcaatatgagtagttttgaatgtatacacatagaagataataatgatagtgatggccaacatttattgatcactcaatatttgccagggactatgaaacctctttacatgaattatctcatccttgagataatactgtgaggtgagtactatgattattctcattttgtaaataacaaaactgagactcagaaagtttaagtaacttgcccaaggtaagtaagcaatagagtcaaggttaaatactccaaatttacataaaggctgttaaccctagtaatctttaagtgatgggattatagttatttttgttgtctgctttatattttatttatttatttatttattttgagacagtgttgctctgtcgcccaggctggagtgcagtggcatgatcttggctcactgcaacccccaccttccaggttcaagcaaccctcccacctcaacctcctgagtagctggtactacaggtgtgcgccaccacacctggctaatttttgtgtttttactagagatggggtttccccatgttgaccaggctggtcttgaactcctgaactcaagtgacccatccacctcagcctcccaaagtgttgggattacaggtgtgagccatggtgcctggcctctactttatatttctctttatgcttataattttttatttttttaattgataaatgataattctatatatttatggggtacagtgtgatgttttgtttgatgcatgaatatattgtgaaatgatcaaatcatggtaattagcatactcatcacctcaaacatgtatcatttttgggggttgagagaggatttagaatcctctcttctagttattttgaaaaatcttaattttataaaataaccacttattacttttgtaatcagaaaaaaaaaaatagctcttcccagatattcttgccacacagagatgcactgacttctggggaaagtgtcctgggatgaggttagggccaagggtcttgaggcaggaaataatacaaaatagttctgtcacccaggctagagtgcagtggtgcgatctcagctcactgcaacctctgcctcccaggttcaagcaattctcctgcctcagccttccaagtagctgggattacagacgtatgccaccacaccaggctaattttttgtattttttgtagagactgggtttcaccgtgttagccaggatggtctcaatttcctgacctcgtgatccacctggcctcggcctcgcaaagtgctgggattacaggagtgagccaccacggccagcctgtttattttttattttttatttttttgagacagagtctcactctgtcgcccaggctggagtgcagtgacacgatctcggctcactgcaacttgtacctcctggttcaagcgatcctcccacctcagcctcctgagtagctgggattacaggcatgcgccatcacacccagctaatttttgtagttttagtagagacgggatttcgccatgttggccaggatggtcttgaactcctgacctcaggcgatccgtccgcctccgcctcccgaagtgctgggattataggcgtgagccactgtgcctgacacaaaatagttttcttgtgctcagcttccccttctctgtgaatagtccagttttttcctaagaacattacctcccaactacagactagaaacttggctgcctcggtttggacccttgcttctgagcaagtagaatcttgctgaagaagggaatggcatgtggggcagtgacaaagggcaggaactacctgctttctgaatttcctactaaatttcctacttaaagccctgcatttcacactatccccctcatagctgtgggttatgcatcaggagttctgatttggtgcctcttgtttacttctctgccacctctgcctccagacccagggtcagggagcctccttttggctctggctgggcagccaccttggttagtccagaaggactcgtggctcccagagggtcatcatagcttggtactgttccatcgtatgtcagctactccaccttccacctgatcacaaccagtcttttcccaaacttggatcttttgaggaaagatgagacaagaaaatgtagcagactccatgtgaacccttctctagacctaggaaaacttattcaatactcctccttactaagagctaatcagtatatgaaataaagacactcaggaagtttgcctgaaggttaactcagagacctgggagtgaaacctagctctcctgcttcctaggcccctctgtgccatctatttttagccaagctgccctgagccttgtccatcttgtctgaaagccaaagtaggcacacagtttgctcataaacattcctgtgcttgccagctcatgctagccaaccatttagatgttggttttaaaactgcgagccttcccttgtacctacctcctaaggcctgcaaagaatacacaccaagggatcaatagcctgagtttttcccgaagccaagtgacctcagtcaaatgccctcaattgagaggcgtgtctattactcgttcatcttggcacagggtgcagcaaatgactccctctcagagccactgttcctggtcacagttctttgagtgtgctgacctactttctccccttcacaggaaaaacagaaaccaataaatgtctccagtgagtaatcttgctttcaggagcactgactctgtgttttggcctcttgtcctttccctgctccattatcactctgctataaccataagaaaatggttcatgactgaactagaactctgtttgttgtttactgtccccattctgtagctgggttttcagagcaactatggcccacatatcacagggatgggggcagagccctccctacctttcctttccctactacaattcattgctaaatagcataatgtggactaaagttgcttctgcacaagaatgttgggaatcaacagagtatctctggttttggccacacatgctatgcgactggtagcattatggactgagaggcattcagcttgagactcctgacttaacttactatatacctttggagtgggcctctaagaagagtcaggtggctcaattcggttgccttgacaagcagaacctctttactgagcgtgtacaggtgactctcaaatacccacactgagattctctgtggctaatggattattttaggctgtccttacccttcacagtcttcatgctattgcccactccctccagccatcatctggaagcaacttggaaatatatgctcattttaatgtcagtctgagaaaagttaactagaggaataaatctactggggttcagaggcaaggtgttgataggacatataatgtattccagagtgccttttggattatctaccggtttttaataacctggcatgtctgttcttcatgaccatggataactgagtatatcttattttgctcccctatccctgggcactgtgtctcctttcttcctcacttgtccttgtgtgtacaacagattataaccagcttgccttctagaatcctgtcaaatttcatttatatcgaatgtgctggccaggtgtggtagctcacccctgtaatcccagcattttggaaggccgaggtaggaggatcacttgagcccaggagttagagaccagcccgggcagcatagcgagacctcatctctaccaaaaaaaaaaaaaaattaaaatagccaggcatgatggcacatgcctgtagtcccagctacttgggaagctcaggcgggaggactgcttgagcctgggagattgagactgcagtgagcctgggagattgagactgcagtgagctgtgatcatgtcactgcacaacagcatggacaacaaagcaagaccctggctcaacaaactggaagtgctaacatgggcttttaaaaaggttccaagtccttttcaccagctccaaagtcatattcgaagtctgggcaacatggaaaaactcgtctctacaaaaaatacaaaaaaatagccggccatggtggcacacacctgtagtcccagctacctgggagtgtaaggtgggaggatcacttgagcctgggaaagggaggttgcagtgagctgagattgtgccagtgtgctccagcctgagtgacagagtgaggccccgtctcaaaataaataaataaataaataaaatcaatatacattaggaagcaatgaggttttttttttttttttaaagcaagttgtagacagatatatactggatgatactgtttttatcaacttggatagaaattaatacacaaacaagagtatattttgtttgaggataggtatatatgtagcaaaacacagactgaaagactaagcctaattcatgataagtcatttcaaccacttcgtatcattccatcatgtaaacgtaccctgattatttatatattatccttttgatggacatcagcttctttccaatttttgtattttgcaagctgtgctgcaatgtacatccttttatgtgtctcccagtgcatatgtgcaaaaagtttccctacaccaatgaatacctagaattagaattgttgggtcctatagtatgcttactttcaactttacaaaatattgctaaattgttttccaaagttgttgtaccagctgggcacagtggttcacaactgtaatgccagcactttaggaggccaaggtgagaggatgacttgaggctaggagtttgagacctgcctggactacatagcaagaccccatctcaattaaaaagataatacaaatataaaatatatataaagaaaaaaaatcatattgtagtcatagtggccacaagaggctgcacttcagcaactagcttatctcaggccagctgggccagggttagagtgaacccttcctctgaagagctgggcaggtagcaggtggtaagataggacatggctgcaggcaacagccaggaatctctacttctggagtagccattcatacttgtggttgtaaagcatgtgtcccccacccaatcatctgggttggaggtaggatgtggatgaatgacaacaggacctctgcattcacagaactggagaggggagggggcaactgggatggggaatgaggatgaatcgcaagcagcagcagaagtgaggagaacagtagggagatagaaagggtaatattgctagtcaccaaaacaatgggacaaagatcccaaagacatttcagagatcattgagtaggttgtccctcccattacaaattcagagcagggccttgagggcagggtttccagaaaggtgcccaccagacctcagcattcactgcccagggccacctcaggactctgcttcccatgttttggtgaagagctccttggctgctccagccatggctcaagtgagcccatgtgcagttcatgccactgctctggagggtacaagtgtaaaccttggcagcatgcacagggtgctgactctgcagaagtgctgagcgcatgagttatggggccattgtggcatctacctagatttcaaaggatgtatcggacagtctgggggcccaggcagagacttgttgcagaggcagagccactgcagagagcccccactagggcaatgcctagtggagctgtggaaagcaggatcctgcagagtctccactagggcagtgcctagtggaaccgtgggagtgggaccaccactgggaccccagagccgtagagctaccagcatacagtgccaacctgggaaagctgcaggcatgagactccaacctgagacagctgaaacatgtgctgagcccaacaaagccatagataggggcagggctgcctgaggccttgggggctcagcccgtgtcttggtgtgcccaagatgcaggacatggaatcaaaggagattattctatacctttaagacttaatgtggttttctttgttgggttttggacttacttgggacccctttcttcttgcctatttctcccccttggaatgggaatgtctatcttatgtctgtcccactgtattagtccattcttacactgctataaagaaataccaggctgggcacggtggctcatgcctgtaatcccagcactttgggaggccaaggggtgcagatcatgaggtcaggagatcaagaccatcctggccaacatggtgaaaccccatctctactaaaatacaattagccaggtgtggtggtgcgtgcctgtagtcccagctactcgggaggctgaggcagaggaatcgcttgaacctgggagacagagactgccgtgagcagagatcacaccacggcactccagcctggcaacagagtgagattccgtctcaaaaaaaaaaaaaaaaagaaagaaagaaataccagagactgggtaatttataaacaaaagaggttaattggctcatggttctgcaggctgtatgtagattctgtaggttctgcaggaaacatggtgctggcatctgctcagcttctgtggaggcctcaggaaactttcaatcgtggcagaaggtgaaggggaggcaggcatgtcttacatggctggagcaagaggaagagagaggggaggtgctacacacttaaacaaccagatttcatgagaactcaccatcacgagaaaagcacagaggggatggtgctaaaccattcataaaggatccacccccatggtccaatcacctcctaccaggccccacctctaacactggagtttacgattcaacatgaaatttgggcagggacacatatccaaaccacatcacccagcattgtattttgtaaataaataattttgtttaatttttaatctgtttcctcacagctggaggaaaatttgcctcaaggtgaattatgccttgagtcccacccatatctgcttttgatgagactggactttggatctttgagttgacactgaaacaagaattttctggctactgcaatggaatgaatgtatttcgcattgtgaggacatgaattttggggaccagaatagaatgccatggtttgaatgtgtcccctaaagttcatgtgttggaaacttaattcccaatagaacagtgttgggaggtgggacataataagaagtgattaggtcatgagggctctacccttattaatagattaatgtcattatctcaggagtgggttagttattgtaagagtggctgcattataaaagcaagtttgactcttcctgttccctcgctcttaccctctcttgtacttctgcctttcattatggcatgacgcagcgtgaaggccctcatcagatgctggctccatgctcttggacttcccagcctccagtaccatgagccaaataaatttctgtttattataaattacgtagtctgtgatactctgttatagcaatgtaaaacagactaggacactctgcctgtttcaaaaccctccaggggcttccagttacattttgtataacgttcaagctctttactttgacctaataagatatagtagcccttaccaaaatatctgatctcatcccatactatgttatttgtttatgatgcttccagctataatttgttctctcttcagggcctatgcaccctgcataaaatgttctcttaccatctttctcatcatccacatctcagctctagggtcagctcctcatagaggctttccctggtcatcccaactaaggagccacctactctgatcagtatctcatcatatcaccctggttttttttttctctctctctctttttggcggggcgggagtggggttgacctgggctatggctgggtcaagtgcctgctttattcaacaggaaatgcccaagtgggactcacccccacctttcacagtgtaaatgagcagggagcaaggcaggaagctagaaaaataacacatggatctagacgatccagaaagaccctgttaagtcagctcaaggccaagactggtcagcgtgagagaataaaagaggtgacggaaaagccttgggcagcctgggccatgatgggcctagcggaagtagttgggacattcgtgggcaacaaaatgccaggtttgattaaaagtgtccatgacagccgggtccatgggcccttcctccatcactgccaagttctgctccagcttctccaggctggacatgcccaggatgaccacgtctctgtgggcaccctgcagctgtgagtggtggtacatccaccagagggtgggtggccaaggtcatgctgggggcactgacaccatacacggcctgtgtggccttctgcatcagggaaatggcctcaaagtggtgctccttccagaagcgattcctgtgggtctcagcccagctattcccaaagaagtggcccccagactgtttcctgcccttgtcctcatacttgtacttgccggtcagcagacccccagccagagggttgtaggcatagaacctcagtccaaagtgcccaaggcaggggaagagctccatttccacctgccgggtggtggcattgtacatgccatggtacacagtgggcaggatccagcctttgctcttatttatttatttattacttttctttttttttggagatggagtctcgctctgtcacccaggcgggagtgcagtggcgccatctcggctcactgcaagctccgcctcccgagttcacgccattctcctgccttagcctcctgagtagctgggactacaggcacttgccaccacacccggctaatttttttttttttttttgtattttcagtcgagacggggttt[132 bp omitted]tcggccacttcccccagccggcatagttggagaggccaagctccacgaacttgccctcctggtgtcgctggtggcaagcacacagcgtctcttccactggggtgccgtggtcaggtgcatgtaggtagaagaggtccaatcggggacactgcagcctcttcagtgacgtctctagctgggaccagacactgtcaggctttagtgattttccctctcaagggttggccttggtggccaatttcactcagcagtcgccgccgcccagccccagcctcaggccgcccaggatgattttggactggccatcgctgtacatgaaggccatgtccagctcggtgtggccacgctccaggaaagcgtgcacggccgtggcgctggcagatgtgtccatgtggcgccccatctccatgatgcccagcaccatggtgcgccgggccaggatgcccaaggcggcctgcgttggttgtggaagggacatggcgagcatgcgggcctcgggtggcagggagcgacttgtgcagtggatggcggcttggggcatggtgcgagacgcggtgctcaacatgaccatggtgcctgcccctcaccctgttttattttctccctaccacttaacattatctgaaattgtctgttcatttattggcttgcttattattatatatcttcaccgccactagaatgtaaatttcatgagcatggcaatcttatttgcctcagtcctgctgaatgtctagcaactagcacagtacttagcaggtgctcagtggattatttgttgaataaatgagtcaggatatggactggcattgttgaaaccatgggaaatatgtgatcatatgatcacttcaaggagagcctgaagagttaaatgtggattataaaggaatgagcagaggaaagaatgcctacaaagcaatttggaggaacaaccagggaggtaggaggagagacaggaaagtgtgatgttacagaaggcaatcctacttctctccccaaaagcaaccaatgctaacagatgggtgggtatccttccaaatcatgttctatatatttacatacattcacaaatgtttatattacatgcatatgtagttttggtttttatataaatgagctcatagtacatgtattattctatcatttgcttttttttaaaaaagaaataacagctttattgagctataattcacacactacacaattcacacatttaaagtgtgcagttcaattatttttaatatattcatggatgtgtgcaaccactgccatagtcaatttttagaacattttcatcacctcagaaggaaaccctgtatcctttagctatcgcctctttatccttcaacccttaccaaccactaatccactttcagtctctatagatttccctattctggactttgatattaatggaagaatatgtgatcttttgtgactggcttattttacttagcacagtgttttcaaggttcatttatgttgtagcatgaatcagaacttcattctttttattgctgaataaaattgctcttggaggccaggcatggtggtgcacacctgtaatttcaacactttgggagggtgaggcaggtggatcacttgagctcaggagttcaagaccagcctgggcaacatggcaaaaccctgtctctacaaaatacaaaaaattagctggatgtagcattgtgttcctatagtcacagctacccaggaggctgaggtgggaggactgcttgagcctgggaggccaaggctgcagtgagccatgattgtgctatggcactcctgcctggacaacagagtgagaccctgtctcaaacaaaataaaacaaaacaaaacaaaacaaaaaacttgcaacttgctcttggcatatccattgtgtggatatactacattttgtttatctatttgtcatttggacatttgggtagtttctactttttattttattttttgatggactctcactttgttgccaggctggagtgcagtggcgtgatctcggctcactgcaacctccgactccctggttcaagtgattctccttcctcagcctcccaagtagctggcattagagacacgtgccaccacacccagctaagtttttttttttttttttttttttttttttttttttagtagagacagggtttcaccatgttggccaggatggtatccatctcctgacctcataatccacctgcctcagcctcccaaagttttgggattacaggcatgagccactgcacccagccagtttctactttttggctattataaataacatggctatgagtattcatgttccagtttttgtgtggacatatattttcatgtcttttgggtgtgtatctaggagtgggattgctgggtcatatggtaactccgtgtttaacattttgaggaactactggattgtttttcaaagtggctgatccattttacattcccaccagcagtatatgaggcttccagtttctccacatctttgccaacacttgttagtatctgtccttttgattatagccatactagggactgtgatttcacttgcttttttatttaatgtgtatggatttttttctgtatcagtatatatagatagcttgtgtgtgtgtgtgtatgtgtgtgtgtgtgtgacagtctcactctgtagcccaggctgaaatgcagtggcacgatctcagctcactgcaacctccgcctcccaggttcaagcgattctcgtgcctcagcctcctgagtagctgggattacaggctcctgccaccacgcctggctgatttttgtatttttagtagagacggggttttgccatgttggccaggctggtctcaaactcctgacctcaggtgatctgcccacctgggcctcccaaagtgctgggattgcagacgtgagccaccacgcccagctgatatcttacatatttaactgctgcataatattccacagaaaccatgcttttcaagatattcctgcctatatcattgtgttatttcttccaccagggcgcagcagtctggaaatagaaacaatggtggtggatcaattcaattgatccagatttggaagttgcgtggcaagtgagaaggatttggatggtaatggtgagaaaggatttgaaataatttatcaaacctggttcagatcaatcctggtgcataagtgactaacaaggagctggagtggatggcatagcatagtggctagaaccctaaaacaagggattttacatgaaagtggaaaggtaactgtttggttttgcatttacccattccctctgttgagttttttttttttaatactgagttattcactactttgtcttctttttttttgagacagagtctcattctgttgctcaggctagagtacagtggcaatctcggctcactgcagtctctacctcctgggttccagtgattcttgttcctcaaccttctgagtagctgggattacagatgcccactaccatgcccagctaatttttgtgtttttattagagatggggtttcaccatgttgaccaggctgatctcgaactcctgacctcaagtaacccacccacctcagcctcccaaagtgctgggattacaggcgtaagccactgcacctggcctgctttgccttcttaaacagatgattcagaacataatataaccttgtcttgtgactcagggtggccattatgatcatctgcttttgacctggacctctgaggcatgtagcaatatgtctttccttatgtcttttccctaagtgtgttccggatttttgtgcttttgaagaagttctgagatcaacgtattcttggttcttctaatgtgtagctgtttgactaaggactgactccatgcatctcctatgaagtgaagttcatgggttttatgacagcaattttacatgctgcttagatgcttttttctcatctaggtttttagttatattatggcagagattataagaaatctgatctctagagaagtgctggtacttctttaatttggcatagactatttttggcaagctagttttctagcattgaacactttaatgaataagttcatagtcaccctatccacattctttttaatggtagaaaactgtctgtctaatacagtagccattagctacatgtagatttttaaatttaaatatacattaattaagagtaggctgggcatggtggttcatgcctgtaatcccagcacttcagaaggccaaagtgggtggatcatttgaggtcaggagttcaagaccagcctggccaacatggtgaaaccccgtttccactaaaaatacaaaaattagctgggcgtggtggtacacacctgtaatcccagctactcgggaggctgaggcaggagaattccttgaacccaggaggcagaggtttgcagtagccgaaatccgccactgcacttcaacctgggtgacagagcaagactccatctcaaaaaaaaaaaaagaaagaaaaaattcccttattgtactagccacatttcaagtgcttagtagtcacatgtggctactggctaccctattggaaagtgcagatgtagaacactttcatcatcaaataaagttctatagagcagcaatggtttagacattgagccagtctcttctcaggcttcttgtttccaaactagagtctcatggtttaagtgcatccttgtacaagcaaccatgctcatactattctccaacactctctgatttccaacccctgatcattgtcatttgctctctattagtattaatttcctatggctactataacaaatcatcacaagtttagtggcttaaaacaacataaatttattatcacatatgacatagttttgatatttgtccccttcaaatctcatgttgaaatgtgacccctaatgttggaggtggagcccactgggaggtgtttaggttatgggggttgatccctcttgaatagcttggtgctgtccccatgataatgaatgagttctcactctattagtttacaggagatctagttgtttacaagtacatagcatgcctcccctctctctatcactcccccctcaccatgtgacatgcctgctcaccctttgccatctgccatgattagaagcttcctgaggttctcaccagaagcagatgctggcatcatgctgcttgctgcttatacagcctgcagaactgtgaggcaaatcaacctcttttatttataaattacccagtctcaggtgttcctttatagccacacaaaaccaactaaggcaatacagttttggagattgaagttcaaaatcagccattttccagcttctagatgctgcctacattccttagttcatagctccttcctccgtcttcaaagcctgcagcgtagcatcttcaagtctctctgtgactctctgacctccgcctccatagtcacgtgaccttctctgactctgaccttcctgcctcttttatgaagagtccgtaataaagattaggtcgccttggctaatccagagcaatcatctcatttcaagaatattaacttaatcacacctgcaaagtccctttcagcattttaccattatgttataccggtatgttgtgaggaccactattcagcctgccacagacagttttctacagtggcattttgttttcctgtgatggacagtgatccagtggtccttattttccaggaccagagtatgctggtccagcacagagtatgctgatatcccaaggttttatataaagggaggataatgttttaaaatcttattttctgtgagaaaacattttaaatggtccattttcaaggtatgataaatctaagtactggcagccagcctgcggacgtgacaaaccgcacagctcatgcacctagaaagtcgcaataagcaaacagaatgtagaggaggagtcagcctataaaagggaagaaaaagtttacagagttattggaaaatcgaaacttaagcagggaaggggactgggttataaccttataagggataatgaaacttaggtgacgtccagaaagattgtaaccccacagtatttgaccaatgaggaactgggggagggacttgcgtgctaggagataaattacctgctgtagctgccccagctgtgcctgcctaccagacacccattcttgcacgatcaccattaaaattctctcttccattgttcttttgtgtctctgagtccattctttgggtttggacagatgaatgtgtttctcacaaacttgggggcccatctgggatctctgtgcctgcgtggagttggactccagccaagaggggagaggcgtcccacctgatttaagtggcctgctctgtctgggaatcccggctccctgcagaggccatagacaaacctgagactgttattcaggaggcagtggaggtgacacagggagaaaagcaggcaccgtggcaaccaggcaacctcatgtacgagccaaggtaggaaaattggactgtgagtattgtcttggtggttgggcatttttggaggtcgagtgtgtgtgactgagacgtatcctaggtatgaagcaagtgtggagacccaatttgcggttctgttctctcgcgaggggaacagccagagacggatgaaatgattctcggtgtgtgcaagaaacctctagtggggggcttgagtacacagggaaaaactcagacacagattgacgaaaatgggaaacagaaattctaggcctaggggacaaaggaaagagggagccaaagagactccctctgacattcccccggatagtcctttaaggagaatgctgcaggtttggagggacaacccttgaaccagggacaaggaaaaggaaaagatgataaagtattgctgttttacctgtcccaaagaccccattcgcaagccttcagtcttttgatttaagtttggctcagatgagaactgggtgtgccaagctttaattctctatgtgaatgataaaaccccattctaggccgggcacggtggcttacgcctgtggtcccagcactttgggaggccgaggtgggtggatcacgatgtcaggagatcgagaccatcctggctaacacaatgaaaccccatctctactaaaaatacaaaaaattagccaggtgtggtggtgggcgcctgtagtcccagctacttgggaggctgaggcaggagaatggcgtgaacccgggaggcggagcttgcagtgagctgagatcgcaccactgcactccagcctgggcgacagagcaagactccactaaaacaaaacaaaacaaaataaaacaaaacaaaaaacaaaaaccatcctcacaagaagagataggttatgctctctgctggatcaaagaattaacccccacgttccccatcaaagaagaagaaaaagagcctagtaaaaagctcttgcccagtgaaaagccctgggaccccctatcatgcttgcccctccatacagctcacaaaataggggacaggaagatcaagggggcaacaggagggttagaggaagaaagacctggagaccatgggggaaccaaaccaattgctcctttaagtcctcatccaaatttaagaaaaagaacagtgtaagagggatattaagaacttccttatcctgtccacacagcaggcatctagcatgctccctcttagagaagttcccatgggacagggagagactggctttgtaaatgctcctcttacaagttctgaagttaggaatttcaagaaggaaatgaaaccacgcctagaagatcccctcggtttagcagaccagctggaccaattcctaggaaccagcttttacacctgggctgaaatgatgtctatcatgaatattctgttcacaggagaagaaaggggaatgattaggagagcagccatgaccatctgggagaggcaacaccctcccaggcaaggagtcttgccaaccaaacaaaaatttccaaatgtcgatcctaaatgggataataatgatcccagggactggacccaaatgcaggacctcagggaactaataattaaagggatcaaagagtccactcctaggacacaaaatgtctcaaaggcattcaagattcaacaagaaaatgaggaaactccctctgcattcctgcagaggttcctgagaaaatactctagattagatctggaggacccagtagggcaaggccttttgaaggttaactttgtaactaagagctggcctgacattacaaaaaaattacaaaagagtaatgaatggaatgagaaaccagttgaagaattactgagggaagctcagaaggtctttgtaaggagagaggaagagaagcagaaacaaaaagcgagaatcatggtttccactgtggaaaaggtagtcagaagaaggttagatcaagatccctcttgaaggaaacaatgggataatagattttgacacagaggaagaagggaaaagctcctaagactatgagttgatgttacaagtgcggaaaaccagggcattttaagagagaatgtcctgaatggaaaaaagaagaaaaaatgatccccttcatgacggttgatgaagacaaggggggccaggggttccttctgagtaggaccctccaggaaccgctgataaatgtgaaggtgggacccgagggagaagaagtgacagttttggttgatactggggtggcttgctcctccctaattcaccaaccaaggggtacagaagtctctaagaaaaaattgacagtatcggggtaaaaggggagggatttcaggttctgatattcaaggaaatgttaattagattgggacctgaacaaattgaggtgtgactcttatatgttcctgaagcaggaactaacctccttggtcaagacctgattgtgagattgggtttaggattaggaatagaggaaggacaaataaaagtaatgatgggcctcctaacaaagcaagaggaaagaaaaattaatccccttgtgtggattagggaaggcaacaggggagggttaaaaatcacacccttacagattaaactaaaacaaccaggagaagtagttttcagaaaacaggccaggcacagtggctcacgcctgtaatcccagcattttgggagac[134 bp omitted]gaggcaggagaatcacttgaacctaggaggcggaggttgcagtgagctgagatcatgtcactgcacttcagcctggcaacagagtgagactccgtttcaaaaaaaaaaaaagaaagaaaaaagaaagaaaaagaaaacaatatcccatttctactgaagggagaaaagatctccaactggtaatagagggattgattaaagatggactattagaaccctgcatgtcactatacaatactccaattttcccagtcaaaaagcctgatgggttctatagattggtgcaagatctagggactatgaatcaaattgtccagacccaccatcctgtggcacctaacccctacgccctccttaataagatactctatgaacataagtgattcagtgtggtgggtctaaaagatgtattctgggcatgtcccctagatcttaggagcagggacctctttgtctttgaataagaaaatcctataactgggagaaaacaacaggactgctagactgtgctgccacaaggtttcatggcagccccaaatgtatttggtcaaataatagaaaaagtccgggaggaattccaaccttccaggggaacccagtcattacaatatgtagataatcttttaatttctggggagaggagggccgaggtatcagaaaccaccataagcttgcttaatttcctaggagaaaggggattgcaagtctctaagaacaaattgcagtttgtagaaaaagaagttaaatatttaggacacctgattagtgaagggaagtggagaataaacccagagagaatatctggaatagtgggcctgcctttgcctaagacagagagaactccgaaaatttttaggttcaactggctactgcaggttgtgaattgactcatatgctcaaaagacaaaaattctgtatctcaagttactagaagaggaacccgatcccatgcaatgatccccataggaaattcaggtagtgaaagagctaaagcaggccctcattactgccccggtcctggccctcccatctttagagaaaccattccatctgtttgtaacagtagaccagagtttggccttggagtgctcactcataccgggggagggaagaggcaacctgttgcttttgtctccaagcttcttgagcctgtctctcgggggtggcctgaatgtgtgcaagcagtagctgccacagccctgctggtagagtcaaaagctaactttggtggggccctaatagtaagcacccacaccaagtcaggaatatattaaatcaaaaagccaggaggtggttaatggattcttggattcaaaaatatgaagccatgtcactagaaaaagataatttggctgtaacaacagatacttgcctgaatccagccagtttcctatggaaaggagagaagaacaaagagacatcagaccataactgcttagatatcatagaataccaaatcaaagttagaccagaccttaaggaagctccactacatgatgggataaggctgtttgtggatgagttttcccaagtgacaaatggcaagagacataatggttatgctgttattggtggaaatagttaaccaagtaatgaccctaaaagggtagaaataattgaggtaaaggatttaaggcaaactttagaaattgagacagggtacagggatgtgaatgcctggttcaaattttcagtacaagccctcaacaagagtaattgctggctgggc[137 bp omitted]gtggcacgtgcctgtaatcatagctactcgtgaggatgaggctgaggctgaggcaggagaatcgcttgaacccgggaggcggagtttacagtgagccgagatcatgccaccgcactccagcctgggtgacagagcgagagtccgtctcaaaaaagaaagtaattgctatgtgcgtgctgcgggacgacctcaggcccaggtgattccatttcccctaggatgggataccgatcctgaaggcatgcattgcatgttggctctataccaggacaaagatgcatgggaaatgagacttgtaagagcctgtcattgttctttcctgcattgtggtggtcagatcccagagcaatcccctcattctctatagggaatatgaaccactcctcttgtctctctaggcagggggcagagttcaataagcccgtgggagaactctcgtacttgtacccacatcctaattgtcactgctgagtcaggcaatggcaattactcagctctccatatactctgggctgttgtctggtggtattgtgggaaaggggacctccataacctgttagttactgtccaactggaccaggacttgtgctttagtccaattggccattcctttcaccctggcattccataagatacccgaaaatacacatggccaccaaaaccagacagatttgacaaattcttttgatcccaatatatatattgactcgacaggagtccccaagggggtgcctaatgaatttaaggcctgaagccaaatagctgctgggtttgagtcagcactcttttggtgatcaattattaataagaatgtggattggattaactatatctgttataatcaacagagattcatcaattgtactcaggacgccctcaaagaggtggctagcgagtttgatgccaccagccaaatggcctgggaaacagacttgtgctagacatgatactagcagaaaaagggggtgtatgtgttatgctagatgggaaatgttgtactttcattcccaacaatattgccccagatgggaccatcaccaaagttttacaaggactgacaactgtagccaataaactggcagaaaatgctggaattgacccatttacagactggctagaaggttggtttggaaaatggaaagacatggtagcttcaatccttacatctctcataattgtggcaggagtcttaacagcagtgggatgttgtattatcccttgtgtgaagggagtagcacagagattaattgaaacagctattaataaacaaatgccaatgacttaccagcaaaataacctgctactattagaaaccaaattaaactcactctcctataaggaagaaagtagacaacttctagagtgattggaggaccaaaagggtttagatgaaaatgagaccaaaggaagtaaataaaaaagaggagggaatttgtgagaaaacattttacatggtcaattttcaaggcatgataaatctatgtactggcaaccagcctgtggacatgacaaaccacatggctcatgtacctagaaagtcatgataaggaaacagaatgtagagcaggggtcagcccataaaagggaagaaagttttgttattgggaaatcgaaatgtaagtggggtaggggactggggtataatcttataaaagataatgaaacttaggtgatatctgggactattgtaaccccatagtacttgaccaatgaggaactgggggagggacttgcatgcaagagataaattacctgctgtaactgccccaggtgtgcctgcctaccagacacccgattttgtaagaccgccattaaaagtctcgcttccactgttcttcgtgtctctgagtctattctttgggtttggacgggtgaatgtgtttctcacattttctgcctttcgcctatatggaaataccaaaatatgattgttctgaccttcaaaatatgattctgtgagtatagtggtataggagtatcttatcagcaagacaaatccacagctaactcaatatcctatcagagtgtttggctactgtaatacagttatttcagggctaatctctgccaacttttcttctcaaacacacacacacacacacacacacacacacacacacacacacacacatagggatatggatgcacccataaacaaaaaactgggggctcgatatattaaccaaagcaaagccttctgagcttctctttgccccccaaaaaaggatgataaatgaaagtctgaatcattcctaggagaagaagcagcagacaccaatgcaggattggtcttccacttccagtctggacaagatagcatagactcatttctccctgcttctcccaggtaagcccaaccagaaatcctggaaataattcaagaggtggccacaggagaattctaaaaggtgtaaaggggaaggcagaacgattaggaatcccaggactggaggaacaccatagtagcagggtaccttatgactctcaagccataaatgtgacccaggcccagcatttcccaaaccccaacgtagcaatagaaaatggttcctgtaggttcctttctcctctgcattgaatgggagtcctactgacaccaacaggtaagcctggcaactccagcaagtgggatttagcaaggtgcctcactgacaataagcagccagcagaagtgctgtcctttcccacaaggtcagagactcccctaccccactgaaagatactctccaagcaagcacaccatcaaggggaaacgtgaccatgacaagtagcctagcccaggaagcctgtttgttttcatggtcttgaggcttctctcttcctctgagagataccaggaaggcaggcagcaaagtcaggggagtcccaccagaaccagcagagacaaggaagattctttgtttccacagactagaaaaatcacttcccccacctagaggcaccaggcaaccctatctgaggaacactctgcttcctcaggcagcaccagcagggaagagtggacccattagcaccacatgaatcaagcagatcaaaatagcactacagaggctctgaaactaaattgtcattggaatcacagccttcaaaagtaggccaggacctgcatgctaaacctaaacaaactgactgcctgctaaaatcaaatatttaagtaggaattagagtcttctaatataatagtcaacatatccagaatatgataaaaatcaccctaaaacaatcaactgataccaacaccaagatgaattagatgttgaaattatctgacaagggatttaatgtagccaccacaaaaatgctttaataagtaattgcaaagtctcttgaaataaatggaaaaaatataaaatcttagcatagcaatagaagttatacaaaagaatcaaatatactccaggccagtctgacatggtacattcagtctctgattaagaacgtggagtagggcaaggacaagttaagatgggaaatacatgtgtggttctgtgatggagctgcagctgaattatttcatcacaaggggctcttatgttatcaaaggacacagacctgaaccttgactgagtagttttctgaggggcattgagcacttcctggggagtccagaattgggaaacttggttttgaccttcatgtggctgtgtgactatctcttatctgcctctttctgggaataggaactacttcaaatccaggaagggaggctggtcaaatacaaataacaataaacagcccaatggcaacccttccttgcagtgagtacttactgtgtgccaaacactgaactagatctctttgtgatcatccattcatggaatcctcacagcagccctccactaagggcatttttgagatctcaggtttaattgggttaaagttccctcagtagacacctggggtatctaccagcctacaaggacctgtgccgggtacaggtataggtgatactgtgatgacacccttcatagacacatgtgactagagctcacagcaggtgggggcaagcaagttcctgggatagaacaacatgggggtcccaaggaacaagtggccacattctgggagtgtttgggaagatttccccttggcagggtatttaacttgggcctccagataccagtgaaagcatgggctttggcatcaggaagacttggattcaagtcctgactcctttgcttcttggcaatgggaccttggttaaataacttaacctaaaaaaaaaaatttaacctgactgagcctcagtttcctcatctgtaaaatgggtataagtattgctataatcattgttgggttgttgtgaggaagaaatgggaagatgctcagagcagccctaggcagggatagtctgtgcctctttacttgaaggccccttctgacacaccttcttccaggaatcctttgatctcttcttccttcaaattcatacataatcaggcattttatacatgattaaaacacctgttcacattttctaaagaaccaaatgaaaattacagaactgaaaaatagatttttaaaaattgctggataggatcaattatagagcagagatggcagaggacaaaatcagtaaacttgtttatagatcaatagaatttacccagcctgaacaacagagagaaaatagactgaaaaaaaagatagggcctcagggacctgttagaaataacaaaagatccaacattcatataatcagattcccagaaggataccaaaaccaaagacagtacaaagcaagaaaactatagatgaatgaatatctttcatggacttagacacagaaactgccgcaaaataatagccaaatgaacccaacaatgtagaaaagaattatactctgggatttattcccatgtatgcatagttcaatattttaaagttaatcaatgtaatccaccatatcagcagactaaaatcatttaaccatatcaactggcacagaaaaagcatttgatgataacattcaaacttttttttttttttgagacagggtctcgctttgttacgcaggctggagtgcagtggcacaaacatggttcactgcagcctcaacctcctgggcccaagtgatcctccctcctcagtcccccagtagctggtactgtaggtgtgtgccatcatgcctggctaattttttgtatttttttgtagagacaaggttccactgtgttgtccaggtttgtctcgaactcctgagctcaggcaatctgcccacctcagcctcccaaaattgctgggattacaggcatgagccaccacacccagcttaaagttcaacatttattcatgattaaaaactctcagtacactaggcatagaggaaaacttccttaatctcataaagaacatctgcaaaaaacctacaactaacattatacttaatggtgaaagactgagttctttctcaagtcagaacaaggcaagcatgtttgtttccactatttttttttttttcaggtggagtctcactctgttgcccaggctggagtgcagtggcacgatctcagctcactgcaacctctgcctcctgggttcaagtgattcttgtgcctcagcctcccaagtagctgggactacaggggcccaccaccacgtgcagctaatttttgtatttttagtagagacggggtttcgccatgttggccaggctggtctcaaacttgtgacctcaggttatccacccaccttggcctcccagagtgctacagtcatgaacaaccgtgcctggctgttctcactacttctattcaatatcgtattgtaagttctatccagtacaatggcaagaaagggggaaaaatagctctagcacaacaagaaaaggaaataaaaggtacatggattggaaaggatcaagtgaaactgtgttgattctcaaaagacttaattgtctacatagaaaatcacagggaatcttttttttttaaaaaaaataaaacaaaaaaacctcgtagaactattcactgaattcagtaaggtcatatgataccagataaacacacaaaaatcaatcacatatatatactaacaatgtggaaatctaaataaagaacacaatgccattcatccttgtgccaaagagcaagtataaatttaacaaaacatgaaaggatctgtatgttggaaattataaaacactgaggaaagaactcaaagaagaccttaataattgcagagacatactgtgtgggttaaaagacaacatagtaaagatatcaattatccccaaattgatctataggctaatgaaattcctatcaaaatctcagcaaggatctttatagacatagaaaagcttcttctaaaatttacatggaaaggcaaaggacctagagtagctaaagtgatttttataaagaataaattggagggaatcactcttcccaatataaagggttaccatatatggctatagtaatcaagatactgtggtacacggatatagacagtggaaatgatagatcattgcagacttggaagagtgaggggtggaagggaggaggatgatgagaaattggctaatgggtacaatatatgttattcatgtgatggatacactcaaagccctaactaacttggcctctgtgcaatctatgcatatgataaaattgcacatgtaccccaatattgtacaaataaaaagaaaaaaaagagagtatggtaatgacagagagtagacacatagatcagtggaacaaaaaacccagaaatatagcaatgcaaacttgctcaaacgatttttgacaaaggtataaaagcaacttaaggaaggatagcgttttcaacaaacagttcaggagaattgacatccataggccaaaaaagtgaacttttacctaaacatcccaccttatacaaaaataactcaaaatggatcacagacttaaatgtaaagcatacaactataaaacattttagagaaaaaacaaaaccacaggagaaaatcttcatgatttagggcctagcaaagtgttcttaggtttgacactgtctaggggttatccatgtaagaaaaactacattaaattgggcttcataaaaaattaaaagctttgatctatgaaaggtcctattaagagaatgaaaagacaagctatagactgagagaaaatatttgcaagctacataccc[137 bp omitted]atggcaagaccacctctctacaaaaaaaaaatatataaaaattagctgggtgtggtggcgcgtgcctgtagtcccagctactcgggagactgaggcaggagaattgcttgagcccaggaggtcgaggcaggaggtaccaccacactccagcctgggagatagagcaaaaccctgcctctggggtggggatagattaacacaccctattttgatttcctagtgctgtctcctggtatgaagatttatatagcaaaggcttggttttttcattaaagtgatgttcaattaaacttggttactgagaatttccagaaggcaaacaattcttctttggattaccagaggccctaaggtgctacatactcaggtttgggaagtcattcttctttgtaactatccagcctggtagccagatggccaatgagtttcatgcctgcacaatgagccagaaaatgttcaaggccccaatttttttgtttttatctttttttaaaaaattaaactttctattttgagatgactgtaggttcacatgcaattgtcagaaacggcacattgagatattatgtaccctttatccagtttttctcagtggtgacatcttatttactgtactatagtatcacaaccaggacgttgctacaacctattactcttgtccagatttcccaagttttacctgtaatcatttgtttctgtttatgtgttctatgtatttcattatatgcattttaaaaaaaaataacagatctttttcactagaagttttatgcagttgtagcacttgtagttcatgtatccaccaacacagtacagaaacgtactttcaccacaaggaatcttttgtagccatgcctatctctttttttttttttttttttgagatggagtttcaaccttgtcatccgggcttgagtgcagtggtgcaatcttggctaactgcaacctctgcctcccaggttcaagcaattctcctgcctcagcctcctgagtagctgggattacaggcacctgccaccaagaccagctaatttttgtatttttagtagagacagggttt[132 bp omitted]ctaatgcctggtacccactaatctgttccctatctctatatttttgtcaagagtgttatgtaaataatcatacagtttataaccttttaagattggctttttttcactaagcaaaattcccaggagttcattcaagttattgcatgaaccaatacctgatttcttttttttttcttttttgagacagtctcattctgtcacccaagctggagtgcagtgatgtgatcacggctcactgcagctttgaactcactcaagcgatcctcctacctcagccttctgattagctgggactacaagcatgtgctaccacacccagctaatttttaatttttttgtagagacagtgtctcactatgttgcccaggctgatcttgaacccctgggctcaagcaatcctccttcctcagcctcccaaagtgcttggattataagcttgagccactgtgtctggcccctgatttcttgttattgctgcatagtattccatggcatggatgaattataatttgtttaatcattaatctgttgaagaatgccaacaatgtatgaatgatacagtttttctgcttatttgccagcatgtgtgttgttaactgttttttaattttagctattctgataggtgtttagtgatatctcattgtgattttaatttgcatttcccttatggctaatgatgttgattgagcatctttgtcgtgtgtttgcaatctatatatcctttttggtgaaatatctattcatatattttgctcattttctaatcggattgtttgagttttgagaggcttttttttgggacggggtcaattttgtattgctataaagaaatacctgaggctgggtaatttacaagaaaagagatttaattggcttatggttctgcaggctgtacaggaagcatagtggcatctacttctggggaggcctcaggaagcttccaatcatgttggaaggcaaagcaggagccggcacatcacatggtgagaatggggtggccagggcagagagagggaagtgtgtatgtgtgtggagagacagagagagagagaagagagcgccaccacacacttttaaatgaccagatctcatgtgaactcagagtgagagcccacttatcaccaagggggtggcccaagccattcacgagggatctgtccccatgatccaaacacctcccaccaggccccacctctaacactggggattagatttcaacatgagatttgggtgaggacaaatatacaaactctatcagttatactgcatagttgatgaagtctgggcttttagtgtacccatcacccgaattgtatacattgtatccaataggtactttctcatccttcaccaacctcccaccctcctaccttttggagtcttctccaatgtgtattattccaccctcattatagagttttgaaaccagaaatcagcatcttgggctgcctgaactattcttagatcacttctctcaccaattggggaaacttacaggacagaagaagccagctgacttctgtacatgtatatggttcttgcccaggagcctccatgtgattctagagccagtcctacacacacacacacacacacacacacacacacacacacacaataggtacaactgcctcaggaagtcatgttttaaggaattcttaaactgccctcctgagtacccccaaatgtctcttgctaaagtttaatcatgtctgaactttccagcatcagaatcatctgtctggactgaggaattccagaagacctccctaaaaatgcagatgcgtcacttatgaggatattccatgatgaagttcggccctgtgggattagaatgataccttttgatttgagatgtgtgagaggtctgaaatggtgctcaatgctaagaaataggaactccagcttacattaagaggtgggacagggaatgaccctgcccagccaggtgtcagcaggagatgctgggactcagagaggtgggccagaaggggaggaaagagccaaaggaggagtgggggcatgctgagtacaaactttgcctatttcataaatatgcctggatcatgccctggtgggccccactattgagttgggtagctagatgcttgttggcttctgccttatctacctaccagaaaaacactaagtaaaagctttgaaattcaattcaataaaaaagagtttatgaatccagtgtacttagccaaaatgagggataaggatgacttctggttgcaggagggctttattctttgtttagtttcctcttcttttgtgcttcccctttctcctcaaaggcaagccatcacggaggtcctaaggaactcaattgtcaagtattgaacactgccagtttctataaggaagggagtcagtctgaggtaggaggatttaacctggagctgaaggcaataggacaatctttgcacactgcatccagaagtaagcatcccttctggcccgacacggtggctcatgcctgtaatcccagcactttggggggccgaggcgggcagatcacttgaggtcaggcgttcgagaccagcctggctaacatggcgaaaccttgtctctaggaaaaatacaaaaattacccgggcatggtggtgtgcacctgtaatgaggcgcttgaacccaggaggcagaggttgcagtgagctgagattgtgccactgcactccagcctgggcaacagtgcgagaatacgtcttaaaaaaaaaaagtaagcttcccttctgcctggggttaaccagggccatggtctttttcacctttttttttttttttttttttttttaagacaagtcttgctcttgtcgcccaggctggagtgcagtggcacaatctcggctcactgcaacctctgcctcctgggtccaagcaattttcctgcctc[134 bp omitted]cggcctcccaaagtgttgggattacaggtgtgagccaccacacccatcaccagtgttattttatagctcccctcccaactacagacatatacaactaatgaagtaagggtgtgtatgtccagcaacacagctaatttctgtcaattggccaatgctcaacaattgacaaattagtagactgtgcttgagttgacacttttacaatccagtgcttcataaaacagatggctgcttgttttattcatatataagtggctcttagtgcatcaaaaggatgtttaaaacaacaaaagaacaatcaaaagcacaatttgtcacctcgattcttaacagattcaagccgtataatgatacgagcctttggttaaacaagcaaaatgacagattgccagcagaggtattgaggcaggcacagtcccattcctgatgggttctggccatgacacctgtacaccaagcaggtgtgtttacgtgtgccccaggaagtgggagatctgagcattaggatattccagacctcttcacattagtagtcataaaggaagtgcaatttgaggaagagcagaaataaaatacactcaggaagctagtaaggcattctgagacccaaatgagaacgggaaagaaatgcatctttagtgctgatgcagtcaggagcctttcatgttgagcctttcacaaatgaggtgtgaacattttcaactgaggtaacaacctctcctccatttttgttgatctaattttccatttcagttgctccttctctgtacccagccccactgtgggactgcacgctaattatctcatggtggttataccatctgctgaaaaagctggcagctgggcaatcaccgtcttccaaaattgtggcctccctctacctgccctggtacaaaaaacagaaggcagtgtgttgacccctgtaccctgctccagggactgcatcagcttcacagattggaacagaaacctagaacttaacccgttctccaagctggagcctcctgtggggttccgtactgaggttttgggactcagcctatgtctacacattgcctaggtggtggacccgatgacacggtcaatatggtgaaagtaattgagaagagtaccagacgtgtggtttgtgatccaaggtctgaggtaaaggaactagttaatttcttggccactgcttttacctctatcagtagccacctgggtacacatgatagctgtttggtcacaagagtgtgagagagtatggatgattcagaataatctcatcctcaatgctagcaaaagaactgaaaggacatggcttattcatagatcagttgtaccatcttttcatagaaaggacagcacaggctgagcatagtggttcacggctataatcccagaactctgggaggctaaggcaggaggattgcctgatgccaggagttcaagaccagccttggcaatatagcagttgccatttattaaaaaatgattaaaaatagcgaggtgtatggccaggcacggtggctaacacttgtaatcccagcactttgggaggctgagacgggcagatcatctgaagtcaggatttcaagaccagcctggccaaagtggcgaaaccctgtctctactaaaaatacaaaaattatctgggtgtggtggtccacacctataatcccagctactcgggaggctgaggcagcagaatcacttgaacctgggaggtggagtttgcagttggccgagatcacgccattgcactccagcctagcgacacagtgagactccatctaaaaaaaaaaaaaaaaaaaaaaaaaagtcagatatggtgatgcatacctgtgtcccaactacttgggaggctgaagcaggaggatccgttgcgcccaggagtttgaggttgcagtgagctgagatcatgcctttgcactccagcctgggtggcaaagcaagactctatctcaaaaaaagaaacaataaaaaagaaaggcgacgtgatctttattcacaccccctctctaaaagtattcttaaacttcagaatagaagcaaggaacttaggtgttacactggaaaatcattccaagctggcagtaaggaagaaggtgagcagggcacactgtctctagactaatttccctccaaaaagctttgaaggtttggtaagaatagttgatgagttgagaacagtagttatacaccctttcttttacatatatcaaaacattctaggctgggcacggtggcagtggctcagagctgtaatcccagtactttgggaagccaaggtgggcagatcacctgagctcaggagcttgagaccagtctggggggc[143 bp omitted]aaaccccatctctactaaaaatacaaaaattagccaggtgtggtggcacgcgcctgtaatctcatctactcaggaggttgaggcagaatcatttgaatctgggaggtgaaggttgcagtgagccaaggttgcaccactgcactccagcctgggcgacagagcaagactccgtctcaaaaaaaaaaaaaaaaattagccatgtgtggtggtgcacatctgtagtcccagctacttgggaggctgaagcaggagaatcacttgggcctagaggctgagacaggagaatcacttgggcctgggatgcggaggttgcagtgagccgagatcatgccactgtactccagtttgagcagcagagcaagaccttgtctcaaaaaaaaaaaatctcttaacattttatgacaactgtgagagaggtaatgaagagagaacaatattcactatctcctcaaaaattagcagggttgaggagtaaaccttgattttatcaggaaaaaaagtggtttgtttccctcttttgagccattgatttgctctcaaggggacacacccttactgttgtacagctgagcactgatattaatagcaagaggtcaatcacattttcccctataactctcacttccttttacttaccatattttgtgactgggtttttggggttttcttctattgtcatgaccttgaaaagaatatagtcagcttctacccatttgtattaatgtaggagagcagtgatacagctacaagaaaagtgtagataaaccaaatgtcaaagaatcataggctgctccaatttctatggctggaagagccatagaaataacagaagccagttcatcacttttatgtttggagaaatagaaacccagagagagaaggtggcaaatctcatgactcctgttcctgttctctttccagaatatgatatatgactttattgccacacactttcctttctaattatgatttgtaaaggttatcagttggcattcctgggacatgtagccaatttggtgttaaaaaaatagatccagagccatacaaatggtagggaaatgtaggcccaaattaaacattaatcctgaacaatcagatccagagtcgactctagctttcattgttaagtgctggctttctcctaggttctgtccttggccctcttttcttctatttagagtagctctacatccagggttggtctatctggcaaacgtaagactaagtctgaattagcccctcctgccccctggcaacttccatcatattctttgcctttataaatttatgaatttgattatcttctattccaaagaggagtgagatcatgcagcttctctcttctgtgtcttgtttatttcacttagtataatgtttccagctccatccatgttgtcgaaaatggcagaatttccttcttcttctttttcctcttcctccccttccccttccccttcttcttcttctccttcttcttcttcttcttcttcttcttcttcttcctcttcctcttcctcttcctcttcttcttcttcctcttcctcttcctcttcttcttcttcttcttcttctcctcctcctcctcctcctcctcctcctcctcctcctcctcctcctcctcctcctccttcttcttcttcttcttcttcttcttcttcttcttcttcttcttcttcttcttcttcttcttcttcttcttctccctcttctccttcttcttcttcgacagtgtctcgctctgcagcctcagtctcctgggctcaagtgatcctcctgcctcagcctcccgagtagctgggactataggtgtgtaccaccacacctggctaattttttgattttttatagacacaaggtctcattatgttgcccaggctgatctcaaactcctgagctcaagcagtactcctagctcagcctcccaaagtgccggattgcaggtgtgagccactgcacccagcctttccttcttttttgaggttgaataatattccattatatatctatacaccacattttctttatccattcattctgccactgcacccagcctttccttcttttttgaggctgaataatattccattatatatctatgcaccacagtttctttatccattcattcatcaaaggacatttaggttttttctacaccttggctactgtgaataatgcggcagtgaacatggaaatgtagctatctcgtcaagatgctgatttcatttcctttgggtgtatacccagaagcaggattgctggatcatatggtagttttgtttttaattttttgaggaaccttcatactattttccataatgactgtactaatatacatttttgccagcagtgtacaagagttctcttttttccacatcctcaccaacacataacttttctctttttgatagtagccattcgttctaacaggtgtgaggtgacatctcattgtggttttgattttcctttccctgattagagatattgagaatcatttaatatacctattagcaattttaatttcttttcttgagaagtgtctatttaggtcctttgcccactttttaattggcttatttgtgtttttggcattgagctatacaggttccttatatattttgggtattaatcccttattggatatatagtttgcaaatattttctcccattctgtatgttgcctttgcattttgttgattgtttcctttgctgtgcagaagatttttagtttgatgaagactcgcttgtctatttttcttttgttgcctgtgcttttgctgtcatatcaaaaagtcattgccaagaccaatgtcaaaaaggcttttctctgttttcttctagagttttgtggtttcagatcttatgtttaagcaatccattttgagttgatttggtatatggtgtgagctaggggtcttagtctttttctgatgctgtaacagaataccaaagattggataatttataaacaatagtttatttgactcatggtctggaagctgggaagtcaaagagcatggcacctgcatctggcaatggccctcgtgctctattatctcatggcagaagggcaagacagaaaataaggggactgaactcccacaataactacatactccattgatagcagcattaatcaatccatgaagttgaagcccttatgtcctaatcatctcttaagatcccacttcttaatactctgacaatggcaattaaatttcaacatgagttttggagggaacattcaaattatagcagggtccaatttcattcttctgcatgtgaatatccagtttccccaacaccgtttgttgaagagactgtcttttcctcattgtgtattcttggcacccttgttgaagatccgttaaccataaatgaatgggtttatttctgggccctctattctgttccattggtctatatgtctgtttttctgtcattactatactgttttgattgctatagctgtgtaatataatttgaagtcagggagtatgatgcttctagcttcttgtatgattgctttggctatttggtgtcctatacgaattttaggattccttttcctatttctgtaaaaaataattgggattttggtagggattgcattgaatctgtagattgctttggctagtatggacattttaacaatattaattctgccagtctgtgaacaggggatgtctttccatttgtttgtgtgttttaaaatttcctccatcaatgttttataatttctagtatacaaatttttcacctctttggctaaattaattcctaaggattttattctttttgttgctaatataaatgggatttttttaaatttgcatttcagatagtttgttgttagtttatggaaataacattaattttttaacttttattttaggtccaggagtatatgtgcagatttcttatttaggcaaattgtgtgtggtgggcatttggtgtacagattattttgtcgcctaggtaataagcatagtacctaataggtaggtttttgatcctcaccttcctcccaccctccattttctttttttttttatgaacatggaatatgtctccatttatttggtttttctttttttttaaattatactttaagttctagggtacatgtgcacaacgtgcaggtttgttacacatgtatacatgtgccatgttacctaatgtaaatgacgagttaatgggtccaccctccattttcaaataggctctagtgtctgttgttctcttctttgtgtccatgtgcactccatgtttagctcacacttataagtgaggacatgcggtatttggttttctcttcctgcattagtttgcttaggataatggccttcagctccattcacgttgctgcaaaggacatgattttgggttttttgtttttgtttttgttttgttttgtttttgagacagggtttcactctcgtcacccaggctggagtgcaatggtgcaatctcagctcactgcaaacttcacctcccgggttcaagcgattctcccacctcagcttcccgagtagcagggattacaggtgcccgccaccgcacctggctaatttttgtatttttagtatagacagggtttcaccatgttggccagactggtcttgaactcctgacctcaggtgatctgcccgccttggcctcccaaagtgctgggattagaggcatgaactaccacgcctagctaatctctctctctctcttttttttttaaatggagtctccctctgttgcccaggctaaagtgcagtggcgtgatctcagctcactgcaacctccgcctcctgggttcaagtgattctcctgtctcagcctcccgagtagctggga[137 bp omitted]agctccgcctcccgggttcacgccattctcctgcctcagcctccagagcaggtaggactacaggcgcctgccaccacgcccggctaatttttttgcatttttagtagagacagggtttcaccgttttagccaggatggtcttgatctcctgacctcgtgatctgcccacctcggcctccca[135 bp omitted]ctcccaaagtgctgggattacaggcatgtgccaccacgcctgaccagtcttgttctttttacggctgtaccccatagtatatatgtaccacattttccatggtatatatgtaccatattttctttatccattctaccattgatgggcatttaggttgattcctcttttctattgtgagtagtgttgcagcgaacatacgtgagaaatgacactaatttttgcatattggttctgtatactgtaactttaccaagtttatttattagttctagcagttattttggtagcatttttagggttttctgcatatatgatcatgtcatcaggatatataaatcattatatttctcttcttatttggatgtcttttatttctttctcttgcctaactgttctggctaagatttccagtactgtgttgaatagcaggacaagagtgggcattcttgtcttgttccatatcttagaggaaaaactttcagtttttctccactgcttatgatgcttgtgatggtttttaatatttgggctttattgtgttaaggtaagctccttctatacctattttgttgagggtttttatcatgaagggatgttgaattttgtaaaatactttctttgtgtctattgaaatgatcatatggttctgctttcatcttattaatgtggtgtatcacattggttgatttgatatatttgtatattgaaccatccttgcgtcccactagggtttttgcatctacgttcattgaggatattggcctatagttttttttacttgtgatgtcttgtctggctcatggtatcagggtgatgctggccttataaaatgagtttggaagtgttccttcttccattttttggaagagtttaagaaattttggtattaattattctttgagtgttttgtagaattttccagaagcttgtctagtcctggacttttctttgttggaagctttttgattgctgatcctatctctttgttttttgtttttttttgagacagagtctcactctgtcacccaggctggagtgcagtggcgtgatctctgctcactgcaagctccgcctcccgggttcatgccattctcctgcctcagcctccggagtagctgggactacaggcacctgccaccacgcctggctaatttttcgtatttttagtagggacagggtttcaccgtgttagccaggatggtcttgatctcctgacctcatgatccgcccacctcggcctcccaaagtgttgggattacaggcgtgagccactgctcccggccttatctctttgtttcttattggtctcttcagactttctatttcttcttgattcagtcttggtaagttgtgtgtttctagcaatgtattcattttttctaggttattcaatatgttgttcataatagtcccctatgatccattttctgcatcatccattgtaatgtctccactgtcatttctgatgttcttttttctttctcttttttttctgtcactgtccacctagagatacatttctgattctattaatttgtgttttctcttttttttcttagtgtaagtttgttgattttatcttattgattgcctgtttcattccactgctgtctgagaagatacttggtatgatttcaatattcttaaatttgttaagactcattttgtgacctaacatgtgatctatcctgcagaatgttccatgtgcactaaagaggaatatgtattctgctgctcttgggtagagaattctgtatatgtctgttgggtccatttagtctatagtgttgttcaagtaagctgttttttaattgattttctgcctggatgttctatccattattaaaagtggggtattgaagtttcctactgttattgtagtgctgtcaattcctcccttcagatctgtcaatatttgttttaaatatttaggtgctctgatgctgggtgcatatatatttttaattattatattttcctgcagagttgatccttttatcattacataatgaccttatttgtctctagtgacagtttttgacttaaagcctattttgtctatgtaagtatagccacccatgttcaattttggttatgatttgtatggaatatctttttcctcattccttcactttcagcttatgtgtgtttttatatctaatgtcagtgtcttgtaaatagcatatcactgcatcttgtttcttattcattcagccactctatgcctttagattggagaatttagtccattaacattgaaaataattattggcacataaggacttactattgctattttattattttttatctgttttgcagttctttcatttctctcttgctgtcatcttttgttatgtaattgtttttgtagtttatcatctactgattgaaccacttgcagcagtctctgcctaatttgtttccctgcctccataattgcccttcttcaattctattgcaaatttatttatttatttttatttatttatttttttgacacagagtctcactctgttgcccaggctggagtgcagtgtcatgatgttggctcactgcaatctccgcctcctgggttcaagcgattctcctgcct[131 bp omitted]ctcggcctcccaaagtgccgggattacaggcgtgagccaccgccccagcctgcaaatttatttaaaccagtttagcctctcacatcatcaggtacttttcagtgatatcagtagcttctaatggctagaggtagctggggagtttagttcttcctcatcccccacaatctcccaaccagttggtatgttctaatgaaaacacaaatttggtgcaattctgtcaatcatgcattttttttagcacttagacgtagtcttgaaacctgtcttcacaagctccattaagccccatgtaggagcaattcacttgaagcacatgcagcagttctccagtagtagcattttagctcaatgggcagaccaggcaatagaatcatccattaggtgtcaggatgtagaaactagtagattcctagaactaagatgccactctgggatcaccagttttttaggcttcatttatgtgagggtagagagaagtgtccatccatgtatctagaacaccatttatttcatgaatgaatgactcttttatgtgaatgagcaacccctctagtgtaggtttaggtagattggttgcagtttttcagtaactgcctctggagggtggactcacaattagtgtctttatatgcaaactaagtgctgctggaaagtgtttgtcactgggggtacttcagatattaactgcccctagagtatgtgtatatctacatgtacatgtgtgtaagtctatgtgtatctcacactgtctctgcggagtatttttaagtaaattgtagaccatataacaaatctactctcccatatgtatctgtctacattgttcccctacataaaactcttttcttctatgattcttctatgttacctacaaaataaagtccaaattccttcaagtgacctacagaactgcccctgcccagaacagcccctacctcttccttccttgtgctttatggtctaatggagaactgccaaactgcttgtagttagcctccatcaacaatactgctgtatgcctgtgttttatgctcatgctctccccctgcctggtaaacctttcccaccttcacctggctctttttttttttttttttctttaacagagtctcgctctattgcccaggctggaatgcagtgcagtggtgtgatctcggctcaccacaacctccaactccctggttcaagcgattctcctgcctcagcctccagagtagctgggattacagacacatgccacca[132 bp omitted]cctcagcctccagagtagctgggactacaggcgtccgccaccacgcctggctaattttttttttgtatttttagtagagacagggtttcaccatgttgatcaggatggtctcaatctcctgacctcgtgatccgcccactttggcctcccaaagtgctgggattacaggtgtgagccactgcacccggccctcacctggctaactcttattcatcttctgtgactcagctccaggcatcagtccttccaaaaagctttcctgtaacctcatttggagttaagcttattcattttatctaacactggtgtagtgtagtgcttactctgtgtcaggaattatattctaagcacatttaatcctcacaactctatgaattaagttttgttattatcttgattttcagatgaggaaactgaggcacatagaggtttaagttgcccatgttcacataatttgtaagtggcaaatccacacttcagatccaggctgtctggctttgaaactgcctttgcaaaaattttaacagtgagaaaagtatggcagtgggggagatctgatctagccaatccccatcttgcctttagccttcaagctacccttaattattcctgggcttgggccaagctaactttgggagatatttagtttatagtttatttttattttgagacacagtcttgctctgtcacccaggctggagtgcagtggtgcgatctcagctcactgcaaactctgcctcctaggtgcaagtgattctcgtgcctcagcctcctgagtagctggtactacaggcgtgcaccaccacacctggctaatttttgcatttttagtagaggcagggtttcgccatgttggccaggctggtctggaactcctggcctcaagtgatctgcccacctcagcctcccaaagttctgggattacaaatgtgtgctaccacgctgggcctatagtttaaatgctaatagcccttacccaaaactcaactgccttttaaaagctaatgagagaccaccaggttaggaggataaaggagccgaattctgccaaagtgtagacataaacgattggtaaccattattccagaggtcaccagatacgcaacttccccatttactctgcagataacatcactattgtagaacctaagattggctttttgagatatcatttcagggttttcgcgtgtctgaaggactgatggctccacctgaacctgccaaccactcctgtggcctcaaccaaaagtgactcagtgcgcatgaggaccatttcccatacccccatgtttgtaccaccaaccaatcagcagcaagcacccattacttagctacccccatcccttcttctaaactgtctttgaaaaaccctagcccccaaattatcagggagactgattgcaatgatgactccatttcccacatggcatggctagcctcatatctattaaattctttttttggggggggggcgggtagagggtctcactctgtcatccaggctgagtgcagtggtgcaatcatggctcactgcagccttaaactcccaggctcaagagatcctcccaccttagcctcctgagtagctgggaccacaggtgtgagccaccacaccctgctaatttttgtattttttgtagagacagggtctcgccatgttgccaaggctggtctccaactcttgggcttaagtgatccacctgccttggcctcccaaagtgctgggactacaggcgtaagccactgtgcctggcctaaactctttctctattgcaatgccgtggtctggttttgtctgtgctgtgggcagaagaacccatcaggcagttatagctttggagtctgtgctctaaatccatatgcagtgctacttcccaagggcacatcctctgtattccggcatgcttctatcttagcatttagcataataattagaaaatgcgtcatttcatatgtgcctgctagtctaccatgaggctcttaaaatgtattaatatctaaggcagtatggtatagtggttaagatcatggagtttggaattagacagaactggggttaagttccatctctgctatgtattgggtgtgtaaccttaggcaaattatttaacctttctttttttttttttttttttagatggagtcttgctctgttgcccaggctggagtgcagtggcacgatgttggctcactgcaacttctgcctcccaggttcaagcgattctaccacctcagcctcccgagtagctgagactacaggtgtgcaccaccatgcccagcaagtttttgtatttttagtagagatagggtttcactatgttgaccaggctggtctcgaactcctgacctcaggtgatctgcctgtcttggcctcccaaagtgctgggattgcagacatgcaccaccatgcctggccaaattatttaacctttctatgacttgcttttttcacctgtaaagtggtatctcctcactcctagccagtgcttttccccaggggtaaacatttccaatctttctatttctgcaccctccatggtttatttctgactatctggacagaaaaagagaggacaattccagccttgtcctgagcataaaaccactagcatcgaccctagtttattttgtgcactgtgtgctttgactcatgtccagatcctcttcctcactctggaaccccctacagatccctcatgatctggctagagaccatataaagtggggctaagaatacctcacagggtaatggaaagaatgaaatgagatgatgtatctaaagcatctggcagagggtcttacatagtaagaaactctgagtaatgcctgacacttataactcgttattaatatctctccatctccagcaaccagcacggtgcctggacaatagacatttgagaactatttgttgaactgaactattttggaaaactttaggctgacatagacatctgaagcatatcttagtatatatgacttcagaaatgattctctgtagttaagcagaatgtgctacctcactttgctagggcacccaaaagagttttaactccaaagagtagatagccctgtaactctccagtcatgcaactaataagcatatctttctggtccttgaagccatcaattttaatgcagctgaagctcaaatgggatagctcaccactttgaagtcagacttgttatcgtaagtcatctcatcatcattcaaaatgaaagagaaccccatttcgtttcctttccttagaacaagggcttcagaactccccagggctagctagtctcattggatcgctgaccttttcagtattgaaattcctatgcaaatttccttctcagcatcccagggctttgatcctttgtgcgatgaattttatttgtcgaatggatgaaaaatgcagttatcagacatgcccaggtcacctttggagagtgttgtgataacaaatgtccccaaatgcgaccattgattttctcttcctttgaggaccttaaagagcctctaggttaaccccattatcatcagatcatcagtgatcacttctcagaagtttagctagacagaaaaagtggatgaaattgaactgaatttgtatcaatcccagtcattgcctaaaatctggcagttcaactaaaactctgatagttggttatgttgtcacttttctcttttccctgaaaactggtatatggaacctcccacccaccaccaacacgcacaaaaaagcccaactagtggaggattatggattcacatgttctgaggggatttaatttgaggaaagaatgactctagtgtggttttgatcaggagaggctgcctggagaaggtctctagccagaccatgaaggactggtaggggattccagagtcgaggaagaggatctggatgtgaggcaaagcacatagtgtgcacataataaactagggttgatgctagtggttttatgctcagggcaagactgggattgccctctcttctgtccaaatcatcagaaacaaaccatggaaggtccagaaacacagaggctgaaaatattcacccctagggaaaagcacttgctaggagtgggagatataatttattttcttttctttttcttttcttttctttttttttggagacaatgtcttgtaatatttcccaggctggagtgcagtggcaattcaccggcacgatcatagctcgctgcagtattgaactcctgggctcaagctatcctcccaccatgtccggcagaaaatatgatttctgatctttattctaccactgacttgttctatgatgatggtcaggtcatttaaacctctcttagatcatttccttggcaataagatagatgtataatcaggctaccatacagaactggtgggaagattatacgagagctcacaaatatctatcagatataagttattgagatactattattaaaatgtaaatatcacaggaagggagaccaccttcagtcttgtcagcttgcatcttattggataattaatgcagctgctcaaggaccccacgaaatgggcatcaagtacagagaagagagagaatttttttaaaacaaatgaagaaaccaaatctcagagagctttaatcactacccagttgtgaagcagggactatgccaaatcatttatcataaatgtaaattacttcactgttttgtgccaatactctggaaacctgtttgtatctcttcggaaggccctgccttccacaggaaggttctgccagacatggtgggaggatcccttgagcccaggagtttgaggctgcagtgagctatgattgtgctgggaattggtgagaatttcaagggtaagtggaaagctactgaggagagtattttggaggttggcagctaatctcagatacaaatagtttaatcacttggtgtgccttaatccacattgatctttgagtgacttgatagccccttaaacttcagaaggtaaacctgtttacttctactggtacagaattctaataaaaataaatgtattttgtgtatttggcacaactttgtaaatttttattctattctatgtaaactacaactatatatcattcctttgagcctaacttagaagagagaactgggagttcataacactaaaaaaggcggtaatatcataggcaaacatagcaaacattttttagggaagtctcaggagaaaggaagcaagtgaaagtaaagtgagcatggtaaagagttgcacttggtaggatcagggttcagggagttcaagtttatatcaaggtatatcagcacatgcctaggtagagggagaggaagaaggagaggtagagaagggagaaaaggggagaggggagagagggagagagaggagaggaggtagaaggagaaggaaggggcaagaggagaggagggagcaggcacacacacacacacacacacacgtgcacccacgcttacatgcaagcctgctgctctcccacacctggtaagtgtgtcagagccctcctggtgcttgtccttattcatcaaagccactccagttctctttctagtccctttgtcaatcactctccttctctgctaccagggaaacttgactgagaggaagagaaagctaaagaagtatcaaattcctctctaagacatcttcactagtcttccagaacatctccgccttgggaagcagaactctgaggtccaggaagaccttccgaccaatccactgagacattgctacggctgcctcctcttcactttctggcctcttgagccaacatccaacatgatcttcatgagaggttgccggttacctttctaaaaacgtatttgaccagatttcttcatgatatttcaaaatgtaaaggcagaaaacaagttaaactttaaacaaatttaaatttaaacaatctaaaagggaatttaagtaagcgtatgactttgttgcagaggttctaggcttccttttttacaaaaggatgggaaattttaaagcaactgctctgactaacccagaaaaatctttctttgtttatctcctttgtatttagccccaatatctgagaaaattttaaacatagtttttttttctaggattggtgcctaagggtcattcccttacgaaaaccctaactttttttacacctttgttgaatgaaggagctggtggaagttcaaatttgtgtgttaacatgtgacttcaattagagtctgaagatggccacttgttagtaatctcacactgcatcattttaaaaaaacacagcatttttgttctggtgaagagagaggcactggaattcatccccattgtccactccccacccagtgtattttacagaaattcttaacaagtttaatagtgtgctattataacataattgcagcattacaccagaagcattatcaacactaagtattctccaatttagaatgcatgaataaagtctctaaaactcttaagagtatcactttttctcagctaaataaactaagttcaaagggtaaaaggaatatttcttcttatattgaaggtagcatgtatttgggggtagtattttgataagcatttgtgagctccctgctggtggattttaaaacctccttggcaatctcatggtaactatgaggagtgcgaaagtgtctagagcattattatgtatctgttatggtaacactagctctgtcactttcaacatatggcatcaaaagtcaccctggatgctgacaaaactagtcaacgcatgggaaacaagaaagagtgggttcttagattggcctgaatgtcacacatacctgtcataaagtatcacctagatgcaagaggaactaagaaatggtagttccgatctgcagagccacctcgctgccactatttagcatgatgaaaaggcagtactgatatttgggggatagctaaatggctttgccacagttgtattttggcagttattaggttattgtctcagctccaaaaccagtcttttttttttttttttgagactgagtcttgctctatcacccaggctggagtgtagtggcgggatctcggctcactgcaacctccgcctcccaggttcaagcaattctcctgcctcagcctcctgagtagctgggattacaggcgcctgccaccatgtctagctaatttttgtatttttagtcgagatagggttttaccatgttggccaggctggtctcgaactcctgacctcaagtgatctcccgcttctgcctcccaaagttctgggattacaagagtgagccattgcgccgggtcccaaacccactcttctataccttatttcgtgatgctagcaataggacactgaaaaccacaagtcagttttgtctgctggctttgtgttagcttctgccaataggggtctgtagagggggattgcaaagctgaaggagaaaaggacttgctcctaggtgggttgcctgtctgcttgtagttcctatgagcgccaccccggccttgcctctttaccctgaaaagagcaagtccttcctgtagaattgagtgagtccagtttacagtttttccatcacttgaaagaaccaatctctgccgggcgaggtggctcaggcctgtaatcccaacacttcgggaggacgaggtgggcagatcacggggtcaggagatggagaccatcctggccaacatggtgaaaccccgtctctactaaaatacaaaaaattagctgggtgtggtggcacgtgcctgtagtcccagccactcgggaggctgaggcaggggaatcacttgcacccgggaggcgcaggttgcagtgagccgagattgcaccactgcactccagcgtggcgacagagcaaaactccctctcaaaaaaaaaaaaaaaagtaagagagtaagaactaatctcgacatgccctgctcatagacaacaccaacagtctgtgcccctccttagaaatctgggtcccaatgtgtccggaattggtgggttcttggtctcactgacttcaagaatgaagccgcggaccctcgcggtgagtgttacagctcttaaggtggcacgtctggagtctgtcccttctgatgttcagatgtgttcggagtttcttccttctggtgggttcctggtctcgctggctcaggagtgaagctgcagaccttcgcggtgggtgttacagctcctaaagtagcgcgtctggagttgttcgttcctcccggtgggctcatggtcttgctgggctcaggagtgaagctgcagaccttcacagtgagtgttacagctcataaaagcagcgtggacccaaagagtgagcagtagcaagatttattgcaaagagcgaaagaacaaaccttccacgctgtggaaggggccccaatcaggttgtcaatgctggctcaggcagcctgcttttattctcttatttggccccacccatatcctgctgattggtagagctgagtggcctgttttgtcacagtgctgattggtgcgtttacaatccctgagctagatacaaaggttctccatgtccccatcagattagttagatacagagtttggacacacaggttctccaaggccccaccagagcagctagatacagagtgtcgattggtgcactcacaaaccttgagctaaacacagggtgctgattggtgtatttacaatccctgagctagatataaagactctccacgtccccaccagactcaggagtccagctggcttcacctagtggatcccgcaccgggactgcaggtggagctgcctgctagtcctgtgcagtgcgctcgcattcctcagcccttgggtggtcgatgggactgggcgctgtggagcagggggtggtgctcgtcggggaggctcgggccgcacaggagcccatggagtgggtgggaggctcaggcatggtgggctgcaggtcctgagccctgccccgcgggaaggcagctaaggcccggcgagaaatcgagcacagcgccggtgggcccgcactgctgggggacccagtacaccctccgcagccactggccccggtgctaagtcgcccattgcccggggccagcagggctggctggctgctccgagtgtgggggcccaccaagcccacgcccacccagaactccagctggcccgcaagtgccgcacgcagccccggttcccgctcgtgcctctccctccacacctccctgcaagctgagggagtgggctccggccttggccagcccagaaaggggctcccacagtgcagtgggggggctgaagggctcctcaaatgccaccaaagtgggagcccaggcagaggaggtgccaagagcaagcgagggctgtgaggactgccagcacgctgtcacctctcaccagcatcacagggatcctcttccaagctcagagatttcagcaccagcaagcagatgaccccttttcagaagtatgggttttagctccatggagcccctcccccaaggaagctcctaggcttcccaggcttcttgatct[144 bp omitted]aaaactctgtctctactaaaaatacagaaattagccaggtgtggtggcacgtgcttgtaaccccagctactcaggaggctgaggcaggagaatcacttgaacctgggaggaggagg[134 bp omitted]aggaaatatggattcacatactcaagttgttccaagcatacttaacatttttcattagcggaattataaatttttaactttttactttgggataattatacactcaaaagaagttgaaataaatagtacagagacgttccatgtacctatcacacagcttctcccattggtgacattttctgtaattacagtgcattgtcaaaacgagaacattaactggcacaatgcaactaaccagactggaagtcttaattaggtttcaccagttttggcatgcacatattgtttttttgtatgtctttgtgattatataacatttcctcacgtgtatagatttaaaaaattgtttaattttaatttttgtgggtacatagtaggtgtatatgtgtatgaggttcatgacatgttttgatactggcatgtaatgcataataatcacatcatgtaaaatgggatatccatcacctcaaccatttatcctttgtattataaacaattcagttatactcttatagttatttcaaaatgtacaattacattgttactggctatagtcaccctgttgtgctatcacacactaggtcttattcattctttctattttgtgtacacattaaccatccctaactcctgcccttccccctactacatttcccagcctctggtaagcatccttctactctctctctcttattttttttgagaaggagtcttactctgtcgcccaggctggagtgcagtggtgcggtcttggccactgaaacctccgcctcctgggttcaagcgattctcctgcctcagcctcccgagtagctgggactacaggcatgtgccaccatgcctggctaatttttatatttttactatagaatgggctttcgccatgttggctaggctggtctccaacgcctgacctcaagtgatttgcctgcctcagccttccaaaatgctgagattacaggtgtgagccaccacacccggccaccatccttctactctctatctccataagttcaattgttttgatttttagatcccacaaataagtgacaacatgtgatgattgtctttctgtacctggcttacttcatttagcataatgacctccagttccatccgtgttacaaatgacaggatctcactctttcttatgactgaatagtataccattgtgtataattaccacatttctttatccattcatctgttgatggacacttaggttgcttccaaatcatggctattgtaaacagtgctgcaacaaacatgtgagtgcagatatctctttgatatactgatttcctctcttttgggtatatgcccagtagtgggatggctcgatcatatggtagctctcatgtgcatagatttgtgtgaccactgccactacaatgaagagacagaactgctccattactaccatggaagttcctcatgctgcccctttatttttacttcctctcttccctacaactaatcctggcagccacttatatatgctccatctatataattttgtcattttgagaatgttatataaatggaatcatacagtatgtgacattttgagactggctttttttaaatttaaattttaatttttgagaccaagtctcgctctgttgcccaggttggagtacagtggcgtgatctcggctcactgcaacctccgccatccgggttcaagcgattctcgtgcctcagcctcccaagtagctgggactacaggcacaggccaccacacctggctaatttttgtatttttagtagagatggggttttaccacattggccaggctggtctcagactcctgacctcaggtgatccacccacctcggcctcccaaaatgctgggattacaggcatgagccaccgtgcctagctgaaactgtcctttttattcagcacaatgcccataagatccatcttggttgttggatgtagcaatgatacgttccttttttattgctgagtaatattccatggtacggatgtaccacagtgtgtttaatcattcatctgttgaaggacatttgacttatttttaaattttggttattacaaaaaaagctgctatgaacatttgagtataggtttttctgtaggtatgggttttagtttctctgggataaatgcccaggaatgtgattgctgtgattgctgcaccatatggtaactctatgtttaacttttttttttttttttagagatggagtctcactctgttgcccgggttggagtgcagtggtgtgatttcggctcactgcaacctccgcctcccaggttcgaatgagtctcctgcctaagcctcctgagtagttggactacaggctcgtgccaccacgcccggataattttttgtatttttagcagagacagggtt[143 bp omitted]agtggctctgccctttattattattattattatctttattgatatggagacttgctctgttacccaggctggagtgcagtggcatgatcttggctcactgcaacctctggctcccagattcaagcgattcttctgtctcagactcctgagtggctgagattacaggcgcctgccaccaagcctggctaatttttgtacttttaatagagacagggtttcaccatgttggccaggctggtctcgaactcctgacctcaagtgatctgcccacctcagcctcccaaactgctgggattataggcgtgaaccaccgcgcccagcctgcctctaccattttacatccctaccaaaaacatatgaaagatcctatttcttgacatcttcatcagcatttgttgttatcagtgttttctttttcagacatttgagtaggtgcataacagcatttcgttgtgattttgattggcatatccctaatggctagtgatattgaacatcttttcatgtatatatctgccaccagtatattgtctttggtgacatgtctgttcaagtcttcttttacccatttaaaaactgggtggttggtttattacagatgagttttgggagttctttatatattctggatatatattctttgttagagatgtgatttgcaaatatgttctccctgactgtagcttgttttttgtttgtttgtttgtttgtttgttttgagacagggcctcactctgttgcccaggctgcagtgcagtggtgtgatcatggctaactgtagccacaatctccctggctcaagtgatcctcccacctcagccccctgaatagccgggactacaggtgcatgccagcatgcccagataattttttttttgagacaaggtctcatcttgtcacccaggattgagtgcagtggcacaaccttggcttcctgtagccttgaccttctgggctcatgcgatcctcccaccttagccaccaagtagctgggactacgggtgcacgccaccatgcctggctaatttttgtattttttgtagagacggggtttcgccatgttgcccaggctggtctcaaactcctgagctcaagcgatcggcccgccttggccttccaaagtgctaggaatacagccatgagccaccacgcctagccccagagcttgtctttttatcatcttaacagatgtctttcatagagcagaagttctgtgagcttttcatcaatatgtttaggttttttccttctatgcattgtgcttttggtgtcatgtctatgttcccttcacctaactccaaatcatggtgattttctttctactgtgttttcttcttcttcttctttttttaagacggagtctcactcttttgcccaggctggtgtgcagtggcatgatctcagctcactgcaacctctgcctcccaggctcaaacgattttcctgcctcagcctccccagtagttgggattacaggcgtgcaccaccacacccggctaatttttgtatttttagtagagtcggggtttcaccatgttggccaggctggtctcgaactcctgacctcaggtgatccacccgccttagcctcccaaccaaattgctgagattacaggcgtgagccaccgtgcccggccttttcttttttctttgtctttcttcttcttcttcttcttcttcttcttcttcttttttttttttttttttttttttttttttttttttttttagacagtgtcttgctttgttgccaggctggagtgcagtggtgcaatcttagctcactgcaacctccgcctccctggttcaagcgattctcctgccttagcctcccgagtagctgggactacaggcgtgcacgaccacgcccagctaatttttgtatttttagtagagacggggcgtttcaccatgttggccaggatggtctccatctcttgacctcgtgatctgcccacttt[138 bp omitted]cctctacctcccagtttcaagtgattctcctgtctcagcctcctgagtagctgggattagaggcatgcaccatgacactctgctaatttctatatttttagtagagacagggtttcaccattttgcccaggctggtctcaaactcctgaactcaaatgatcggctcaccacagtctcccaaagtgctgggattacaggtgtgagccaccatgcccagcctcctgtgttctcttctaaaagctttataattttacatttaaatcaaagatcaaatttgagttaatttttgtataaagtatgaggcttaggtataggtttattgtttatttctgcctatggatgtgcaaattttccagcaccatttgttaaaaagaaaattcccgtgtttctggggtcccatgaccaccccaggtttagtgattcactagaaggagtcacaagagtcaatatagcaggttttactcactgctaaagtttattaaggaaaggaaacagagcaaaaacaacaggaaaaatgcatgcattggacagagtccagagaggtcaggcatagacttccccatctgaagccacacaggatgtgctttctctcttgcagtgaactacaggaccatgtgaggaataactctgcccagagaaatctgttcaaacctcagggtctgcggcttttatgtgtagaggaacagctctgtcatggcaacctgacaacagagaccacacagacaaagacttgacctgcagtttatctgaatcttggcagaactccttgtgatcttctcggtatacaagaggataagaggtcccttttgttttgatgtcatcctttttggtgtgtgaaacaaggaccacagggagctggcacctttggctacacttcttttcactccccaggtaagtaataaactgtctgaatcttaaaagcactcatagtgtcttttttattggcgaagtctgtcaggccttagccttttctcacacttcaccaaattacttttgcatcttcgtcaaaagtcagttggacatatttgtgtgggtcagttctttctaacagctttactgaagtatgactggcatacaataaactgcacatattttaagtgtacaatctcactttgaccctcaaagggtctcactttgttacccaggctggtgtgcagtggcacaaacatggcttactgcagcctcgacctactgggcttaaatgatcctcccacctcagcctcccaagtagctgggacttacaggcattcacaccatggctgactaattttttaaaaaaaatttagtacagacgagatcttactgtgttgcccaggctggtctcaaactcctgaattcaagcaatcctcccgtgttggcctcccaaagtgctaggattacaggcgtgagccacct[137 bp omitted]acctgtctctactaaaaacacaaaaaatagccagacgtggtggcacacacctgtagtcccagctaccttggtgaggtggaagaatcctttgaaccccggagacggaggttgcagtgagccaagatcacaccatttcactccagcctgggcaacagagcgagaccctaactcaaaaaaaaaaagaaccccccccaaaaaagaatttatacgttttgattcattgattgattgaatcatacatcaatttttttctgacttctttcactcagaagaattattttcagattcacctatgttagttttttttgttgttgctggtttttttttttttttttgagacaaggtcttgctactgcccaggctggaatgcagtagtaccatctcggctcactgcaacctctgcctttctgggctcaagtgattctcctgcctcagcctcctgagtagctgggactacaggcgtgcaccaccacacccagctaatttttgtatttttagtagagacgggggtttaccatgttggccaggatggtctcgatctcttgacctcatgatctgcccacctcggtcttccaaagtgctgggattacaggcatgagccactgcgcccggccacacctatgttattatatatatcaatagtccttttctttttttgctaagtagtattttgctgtatggctataccacaatttgtttatccatttacctgttgatgcacatttgggctctttccagtttgtaactattgcaaataaagcttctacgaccatttgtatataaaactgaagtgcaatggtgcgatccacaggatggagtgctgtggtgtgatctcagctcactgcaatctccgcctcctgggttcaagcgattttcccacctcagcctcctgagtagctgggactacaggtgtgtgccatcacgcccgactaatgtttgtatttttagtagagatgggttttgaccatgtgggtcaggctggtcttgaactcctgacctcaagcaatccacttgcctccgtctcccaaagtgctgggattacaggtgtaagccaccacgcccgaactaagtggtattttaaaatttcaatttcaattgtcaattactaatatatataaatgaaattttaaaaaaacattaatgatgtagcctgcaaccttgctaaactcactttcagttctagaactttttttagattgtaactggttttctgcatatgagcaattatctccaagtaaagagaatacttcttcctttatcatttgtgagcttttattgcattttattttctaatttctctgtccagaccctccagtacaatgtttgctatggtctggatgcatcccccaaaattcatgtgttggaaacttgatccctagttgcagcagtgttgggaagtggggccttttgggagatgtttaggttttgagggctctgccctctaaatggattaatgccattataaaaaaaggacttgtgggagtgggtttgctctcttctaccacatgaggacacagcgttcctctcctccagaggatgcagtgtttgaggcatcatcttggcagcagagaggtcaggctctaacctgctggtgacttgatcttggacttcacagccttcagaattatcagtaattaatttctgttctttgtaaattacccagtctcaggtattctgttataacggcacaaaacagactaaggcaatgctgaatataagaggtgagaacaaacatccctgacttgttactgattttataaggaaggcacccagtctttcaccattaagtttgttaggtataggattttcatagatgtgctttaataggttgaggatctttacttctactcctatattgctgagaattgttatcagccatagatattggttttgtcaaatgatttttctgcatctattgagatgagcccatggcttttctttgttaatttattaacatggtcaattatattgattgattttcaaatgtaaaccaaccttgcattcctgatataaaccacacttacacatgatgtattattttttttttaatttttaatttttgtgggtacatagtaggtgtatgtatttatgaggtacatgagatgttttgatatagtcatgcaatgtgaaataagcacaccatgaagaatggggtatccatcccctcaagcatttatccattgagttgcaaacaattcaattacactctttaagttattttaaaatgtacagttattattgactatagtcaccctgttgtgctatcaaatagtaggtcttagttattctgtctactgtttttttttggacccattatattttttatattcttatattgctagattcagtttgctaatattttgtttagagttttttgtttctatgttcactaggggatattggtttgtagttttatctgtcttgcttcggtatcatggtaatgctgtcctcatagaatgagttaggaaatattccttcctttcaatttcctggaagagtttgggtaaaattgatgttatttcaaaccttaagtttttggtagcgataactagtgtaaacatccaggtctggagttactaaactggagtttactagtgagaagctttttaactacaaattatatttctatgataggtttaggggtattcatttttgtgtgtttgtatgtgtgtgtatgtatctctatacatacagatagatagataggtagatagctagatagagatataatctcctttaatgagctttagtagtttatatctttcaagcaattagcccatcccatctaagtcctcaaatttattgctataaatgtgtttataatattcccttattaacctatttagtatttgtagaatctgtgttaatagtttttttttttttttttttgagatggagtcttgcactgtcgcccaggctggagtgcagtggcgcaatctcggctcactacaagctccgcctcctgggttcacgccattctcctgcctc[212 bp omitted]attggtaatttgtgtcttctctttgtcctgatccacatagccagagttttatcaattttgcttattatccaagagaaccagcttttggtttcattaaatttctctaatgattttctgttttctattttattgatttctacttcttagtttttgcttaatttgatctactttttcaatttattaatgtggaaatgatgtcaatgatctgaaatcttttttcttttcttacatatgaatatagtgctataaattttccactatatagtgctttatggtatctcatattttgatatattgtatttccattttcattcagttaaatatgccttccaattccacttttgattttttcttgaattcatgttttacttataagtatgccgtttaacttccacatatttgagtattttccagctttctgtttttagaatattatttaattccattgaaatcagaatacatactttgtatgacttgaatacacgttttgctttgtgtattttgaagatttgtcaagtacacaaacatttaggacagttatgtactattgatgaattgacccctttattattatcatcctaccgtgatatttgctgctttgaaatctacttgtttgtcactaatatagccatctgtctttcctgcatctggtgttagcattaattaactagatctattagtttctcatggctactataacaaattactgaaatgttgatggcttaaaaaacatttattctcccacggttccggaggtgagaagtctgaaatcaaggtataggtaagaccacacttccatcatagagtctgagggagaatatattctttgcctcttccagtttctgctgtctgtcagtattcgctggcttgtggctacagctctatctctttctctgctccgtgttcatattgccttctcctctgtgttagtgtagctaaattagctctctttctctcctataaggatacatgtgattgcatttagggcctacctggacaagctcctcgcaaaagccttaagttaatcacatattttgccacgtaaggtaatatttacaggttctggggattagaacatagacatatctttggggccaccactgagtccactacacatggtatatctttctccatcactttatttttcactggtttgtgtatttaaagtgtgtttgttgtgaacagcatacacttaggtcttgcttttttgcttttttattatccagtctgatggtctttttcttttttttgagacagggtcttgttctgtccctcaggttgtagtgcagtggcctgatcatggctcactgtagcctcaacctcctgggttcaagctacacaaacacacacacacacacacacacacacacacacacacacatatattattgtagtctccctttgagttatattatatcatttcacaaataatataagaagagccttccaatagtatacctacatttcctctctcctggcctttatgctgttgtttgcatatattttacttacacataaattataaagcccacaatgcattgttactatttttgcttagtcaattatcttttaaagatatttatgaaataagaaaaatatcatatatatttattcatgaagtttctgtttccagtgttctttattgctttactatagatccatattttcatctggggtcatttcttctgctgctcttcttcctggtctttcaggccaggcatggtggctcatgcctgtaatcccagcactttgggaggcccacgtgggtggatcacctgaggtcaggagttcaagaccagcctggcctacatggtgaaaccccgtctctactaaaaataaaaaaattagctgggcgtggtggcagttgcctgtaatcccagctacttgggaggctgaggcaggagaattgcttgaacccaggaagcaaaggttgcagcaagctgacattgcaccattgcattccagcctgggcaacaagagtgaaactccatctcaaaaaaaaaaaaaaaaaaaggatgtctttcagcatttactacaattcaggtctgttggtgatga[141 bp omitted]aaaccccgtctctaccaaaaatacaaaaaattagccaggcgtggtggcgggcgcctgtatcccagcttctcgggaggctgaggcaggagaatggcgtgaacctgggaggcggagcttgcagtgagccgagatggtgccactgcactccagcctgggtgacagagcaagactctgtctcaaaaaaaaaaaaaagtctttattttgggatgggcgcagtggctcacgcctgtaatcccaacactttgtgaggccaaggcgggtggatcacgaggtcaggagttagagaccagcctggccaatatggtgaaactctgtctctactaaaaatacaaaattaggcgggcgtggtgacatgcacctgtagtcccagctactcgcgaggctgaagcagaagaatcacttgaatccgggaggcggaggttgcagtgagcctagatcatgccagtgtactccagcctaggcaacagagactctgtctcaaaaaaaaaaaaaaaaagaaaaagaaagaaagaaaaaaagtctttatttcaccctttaaaaaaatttacattgtggcaaactacacataacacaaaatttatcatcttaataattttcaaatgtatagttcagtggcattaaccacattcacattgttgtgcagccatcattatcagttatctccagaactactcttattttgcaaaactagaattctatatccattaaacagcagccccccattatcctctactcctagccctgacaactagcgttctattttctttctttcttttttctttctctctctctttctttcttttgttctttctttctttctctctttctttctttctttctttctctctttctttctttctttcttttctttcttttttgacagggtctcactctgtcacccaggctggagtgtagtggcatgatatagagctgctgtgatatgtaggtttatagctttcatcaaattttgaaaacatgggcaaatatttcttcatatttgttttgtttcccttcccttttctcctctcctctggggattacaattatacatatattaagctgcttgaagttgttcaatagctcactgaatttcttttcattttttaataattattttattattctctctttcactggatagtttctattgacatgttttcaagttcatttatctttccttctgaaatgtctgatctattgttaatcctatcagtgtgttttatctcagatactataattttcatatctaagtttcattttcatctttttaatatattacatggttctacataacttttttaccacttaaaatacaattacaataaatccttaaatatcctggtctactgattctaacatctatgttagttcctggtccattttaattaattgatttttaaaattacttgaacatagttttatccttttcagtctttcttttaagatccgttaggttggagcacagcagtgtttttttctagggctaattatttcccactacaagggaagatccttctgaataatctatcaatttaccattaattatgaggttttccagtctgcctatttgggacagacagtattccaagttctgtgtatatgttgggtactgttccttttttttttttttttttttttgagatggagtcttgctctgtcgcccaggcaagagtgcagtggtgtgatgttgcctcagtgcaagctccgcctcccgggttcacgccattctcctgcctcagcctcctgagtagctgggactacaggcacccgccaccatgcccagctaattttttgtatttttagaagagatggtgtttcaccatgttagccaggatggactcaatctcctgacctcgtgatctgcccgcctcgggctcccaaagtgctgagattacaggcatgagccagggtgccgggcggggtactgttccttttagtcctcttgtatagtcctttccttggcttctggtagttccctcacatgtacacacctatcagtacttgaaggtgacccaccaaaactctctagagttctccttctgtgtacttctctcctttctggtattcttccctgcagtctagctgctttgagctccctgaactctcagtcctgtctcttcaactcagggagtcctcctggctctacctcaccttccctgtgccacagccaggaaactctcttcagtcagtaatctgggacaatcctagagctcacctcacttatttcttttctctcagagaatcactgctcttcttgtctgctgtccagcgtattggaaaccatttcatatatttgatccaatattcagtagtttcaaatgtgagggtaaattcagtctctattatttcatactggctagaagtggaagtaccaactaatggtttctaaatataaatttaaatgaattaaaattaaataaaaattaaaattcagttcatcagttgtactagctgtatttcaagcactcaaacgctgcatgtagctattgtattggacagcacagtcttatctgtgctgggtaaaaagttatctttttaccctttaagctacttagttaacaactataaacctagttaataattatttatattaaatcgtctttgaccaaatagctcatgtgatttctttcttctgattagaacctgcttgatacatttattcaggtagttccattatcaaggaagtatggtgacaggccttagaatcttaatgacatgggttcagttgtcacttactagcggtacaagcaaattacttcatctagctaattctcagaatattaccaggaaaaatgaggacaatgttaccaggaaaaatgaggataatattacctgcttcccggagtttgttgtgaggatatatgaaaatatctgacacatagtagatgctcaatatatagtatttccttttattaatttcttcatcatcatcctccgagcacttagatctatccatctcagaaacagcttccaagagtatttcttcccatcttcctgtcaaaaccacaatgtgctttgtcccttttccttgggactgtttttccacaaaggtttatcttgaaaagcaatcatgggtactgcagcacactggctggagtagaggactttggatgcatgactctcccgctcccaaaaacagccccacaacctgccgccccgcaccaccttggcccagctcaggtgacatgtatacctgccagagcgcaatgacgggtgtttggctcttgtttctgctttgagttcttttcaagggaccaggactctagctgcatagttgtgcagggaactacacaccaaaagcaagtgaacaagtctgaatagtaagagttacgtggatcgattgtttaccagagccaggcaccaccaaaagaaatgtgcacactttatcccatgtaatcctccctctgggcctaaaagagcagctggtgtgactgcaggcacccacctcacgtcatggagagctgagtgtatgccgatgggggctcttgagaccccaggtgtgcctgggaggagaggaggaagatgaaggcccatgctcccccacctcctggaaaggctgccactctgcacgtgcacagccaccagaagaccccaaagacagggccctcaggttgcagcagaacctggtcctcatgaaggaggcgctgagggccaccatcatggacgtcaccatggtcctgcccagcaagctggagaagaggagcgtgctcaatgggagccatgcaatgatggacctactagttgaactttgccttcagaaccacctgaatccatcccaccacgcccttgacatttggtcttcagaaacccaacaacctttgagttttaagccaaatactttgattgggaccctgaatgtgcatactgtgtttctgaaagaaaaatttcctgaagaaaaaattaagcctgttccccctaaggtgcctgagaaatctgtgtgtttggtcgtgaattacttgcagacacaaaaagctgttgtgcatgtgagccctgaggttcctctccagaatattctcccagccatttgtgcaaagtgtgaggtcagcccagagcacatggttctcctcagggacaacattgccagggaggagctggagctgtccaagtccctgaatgagcttgggataaaggagctctactcgtgagacaacagaagagaaacctttagaaaatcatcgcttggcaatgatgagacagataaagagaagaaaaaatttctgggatttttcaaagttaataaaagaagcaatagtaaggctgagcagctcgtgctgtcgggtgcagacagcgatgagggcacctcccggctgcccctgggaaggggtttgaatggctgtttaacaacacccaactctccatccatgcactgaccttccattacactgggtccatccctcttgctgggcagcatctcaggggcgtctgtgaagtcagagatgaagaaacgctgagcccctcctcctccaggttcagggccacctgtgaaagacaaggcattggaaagggctggacatagtgcctcatgcatgtaatcccagcactttgggaggctgaggcaggaggatcacctgagatcaggagttcaagaccaaccatggctaacatggtgaaaactcgtctctactaaaaatacaaaattagccaggcatggtggtgcaggcctgtagtcccagccactcgggaggctgaggcaggagaatcacttgaacctaagaggcagaggctgcagtgagccgagattgtgccactgcactccagcctgggcaacaagagcaagactccgtctcaaaaaatatatatatatacacacatatatatacacatatatacacatatatatacacatatatatacacacatatatatacacatatatacacacacatatatacacatatatacacatatatatacatatatatacacacacatatatatacacatatatacacacacatatatacacatatatatacatatatacacatatatatacacacacgtagtgtgtatatatatacgtatatatgtgtgtatgtatacatatatatgtgtgtatatatatacgtatatgtgtgtatatatatgtatatatatgtgtgtgtatatatgtatatatgtacgtatatacatatatattttctaatgtgactgacttattttgagtacttcatgatatgatagctgcattttcataaaaagaaatttaggcacaaatggtacctttttcttgtatgggtctatgataagattatgcaaatggaaaacacgaagctgtttcttctgattaaaaaaaagcaatcatggcagaacaaagctagaggactaatacttcctgatttcaaaacttactacatagctacagtaaaaactgtggtactgcaaaagacagacatattgaccaatggaatagaatagagagcccagaaagaaactgtcacatatatggtcaaatgatttttgacaagggtgccaagaactattcaatggggagaggagagtcttttcaacgaatgatgctaagaaaactgtatatccatctacacattaaaagaatgaagttggacccttacctaacaccatatacaaagattaactaaatatgaattaaatacataaatagaagacctaaaactataaaattcttaaaagaaaacagagcaaaagcttcatgacattggatttggcagtgatttattggatatgacaccaaaggcacaggcaacaaaaaaaaatgaacacattggacttcatgaatattttaaaaattttgtacattgaaagatagtatcagctaggtacagtggcatgtgtctctgataccacctacttggactgaagcaagaggatcagtccaggagtttgaggccagcctgggcaacataaggcaaccctgtctctaaaatgtaataataataaaagaaatagtatcaggctggatgtggtggctcatgcctgtcatcctagcactttgggaggctgaggcagaaggatcacttgagctcaggagttgtttgtttgtttgttttgagacagagtctcgctctgttgcccaggctggagcgcagtggcgtgatctcagctcactgcaagctctgcctcccgggttcatgcaattctcctgcctcagcctcccgagtagctgggaccacaggcacctgccacc[138 bp omitted]ccccaccgagctcaggagtttgaaaccagcctgggcaacatagtgagacctcatcgctacaaaaaaaaaataaaaattaactgggtgtgttgcttcacccatgtagccccaggtactcgggaggctgaggtgggaggatcacttgagcctgggaggctaaggctgctgtgaaccatgatcatgccactgcactctcacctgggcaacaaagtgagaccctgtctcaaaaaaagaagaggaagaagaagaaggagaagaagaggaagaagaagaaggagaagaaggagaagaggaggaagaagaagaaggagaagaagaagaggaggaagaagaagaagaagaagaagaagagaagaagaagaggaggaggaggaagaggaagaggaagaagaagacgaagaagaagaggaggaggaagaagaagaataggaggaagaacaagaagaataggaggaagaagaagaagggagaagaaaagaaaagaagagaagaagaggaagaagaagaaggaggaggagaaggaggaagaagaagaacgagtatcagcaaagtaaaaagctaacctacagaatgggagaaaatatttgcaaatcatatatctgataagatattcatatccagaatacatgtggagaactcctaaaactcaagcacaacaacaacaaaacgaacaagccaattcaaaaatgggcgaaggacttgaatagacatttctccaaagatatacaaatggccaaaaagcacaaggaaagatgctcaacattactaatcattagagaaatacaagtcaaaaacacaatgagataccacttcacatccattaggatggctactataaaaaaaacaacagaaaatacaagtgtttgtgaggatgtggagaaatttgaacccctgtgcactgttggtgggaatgtaaaatgatacagctgctatggaacacagtatgatggttcctcaaagaattaaaaatagaaatactatatgaggccaggcatggtggctcacgcctgtaatcacaacactttgggaggccgaggtgggtggatcacctgaggtcagggatttgagactagcctggccaacatggtgaaaccctgtctctactaaaaatacaaaagttagctgggcgtggtggcatgcacatgtagtcccagctactcaggaggccgaggcaggagaatagcttgatcccgggaagtggaggttgcagtgagctgagatcatgccactgcattccaacctgggcaacagagcaagactccatctcaaaaaaaaaaagggaagaaggaggaaggaggaggaaggaggagggggagaagggagagaatggaagaaggagaaggaggaaaaggagaaggaggaggagaaggagaaggagaagaaagaaggagaaggagaagaagaagaggaagaagaagaagaggaagaggaagaagaagaagaaggcataatactatatgatccgaagaagaagaagaaataatactatatgatccagcacttccacttctgggtatatactcaaaagaactgaaagcaatgcaggctgggtgtggtggctcacacctgtaatcctagcatgttgggaggctgaggagggtggattgcttgagccccgggcttcaagaccagcctgggcaacatagtgggaccccatctctacaaaaagaaatacaaaaattagtggggcatggtggcacgtgcctgtagtcccagctacttaggaggctgaggtgggagggtcgcttgagcctgggaagttgaggctgcagtgagctgcgatcatgccactgcattccagcctgtgtgacagaggcagaccttgtctcaaaacagaaaaaagaaagcaattcaattattttctctaaaagtctcaaaaagagatttgtatgcccgtgttcatagcatcattattcataatagctaaaatatggaagcaacccaagatgaatggatagcaaaatgtggtatatacacacaatcgaatattattaagctttaaaaagaaggaaattctgatatatgctacaacatggattaaccttgaggatattatgctaagtgaaataaaccggtcacaaaaagactatatgattccacttgtataagatgcatagagtagtcaaaataatagatagagaaagtagaatggtggttcccatgggccagaggaaaggggcaatggggagttaatgtttaatggtttaaatgttgcagataccaggataaattcacttttgtcaaacccaaacgaattggagccaggaaagcaggaaggaggagagttcatgcctgcatgtataagataaagactgtgtctcaaggaccttctaaaataaccccacaagatattccttttataggactgcagcaattcagataagatggtctggaaagaacacttggctagcacagcatctccatcaatgaactgatgccaactctgattttgaacctcctgaaccaatgaacttcatttccaacagcttatgtgaaattatcttcgccaataaaagcttccccttccccttcctttttttttttttttttttttttttgagacggggtctcgctctgtcgcctaggctggagtgcagtggtgcgatctcggctcactgcaagctccgcctcccgggttcacaccgttttcctgcctc[210 bp omitted]aggctggaatgcagtgacgtgatctccgctcactgcaagctccgcctcccgggttcatgccattctcctgcctcagcctcccgagtagctgggactacaggcgcccgccaccgtgcccagctattttttttttttttgtatttttagtagagacggagtttc[131 bp omitted]gtggcttgccatagctgtgcaccccagattataatcctctctgcttactactaaataaatgcctcaaattaggagatttttttcctggtgtctttcttttattttttatttatttttattttttgagacggagttttgctcttgttgcccaggctggagtgcaatggcacgatctcagctcttcaacctccacctcccgggttcaagcgattctcctgcctcagcctcccgagtagctggaactacaggcgcccaccaccatgcccagctaattttttttgtattttagtagagacggggtttcatcatattggccaggatggtctcaatctcctgacctcgtgatcagcctgcctcggccttccaaactgctgggattacaggcgtgagccaccacgcctggcctcctggtatctttctttaaggttgataatgggtggtcagatgcggtggctcacgcctgtaatccctgcactttgggaggctg[134 bp omitted]gaagcaggagaaccgcttgaaccccagaagcggaggttgtggtgagcagagatcatgccactgcactccaacctgggcaacgagagtgaaactctgtctcagtaaataaataagtaaataaataaacttgataatggatataaaattccagttttacaagatgaaaagaattctagagatggagggtggtggtggttgcacattatgaatgtagcgaataccactgaactacacacttaaaatagttaagatggtaaattttgttatatgtattttactacaatttttaaaaatggaaaaaagtaattatagttcattgttcacaaattatgatggcttagaatgttccctttcccagaaaaccagaggaagtaatatattttaggtaccatggtggggtcaataaaggagatattagtggtggaggcaaacttctgattgccccagcatagctgacagtgacttctgcatggaaccaagctgaaggatgttaaaactgacttttttttggtgccatgagaccattatcagctctaacacctgagatggccaactttttattatctgagtataaattatcctcgtcatcatttaaatgccccctgcatcatatatgccacctgcaacaacagatatgtctgtgtacacagtcaggcacatatttttatcaatggttctcaactagaggcaattttgccttctagaggacatttggcaatatctggagacaatttcagttgtcacaatttggggagggggttgtcgcatgtcgtgggtggagaccagggatgctaccgctaaacatcactataaggcataggacagcttcacacaacagagagttatcaggccttaaatgtcagtagtgctgaggttgagaatcactggcctaatctgagctcaaaaggaaatgtaaatctgctctgcagccccagaacataataccatgctttccagggctcaatactattgacttttggatttcacatgctattgcttccactttttttggatggaaacttgaaggttgactatgtggtacaaatatacttaaatgtaacccagagcagcagagttttgtttttttttaaggtttccactttgttttctgctaacttgataaatcaatgattttacacaaaatattttacattgatgctttttgaactgcattttgcagaatgcagttgcaatggactgaatgttcatgtcctctaaaaattcatatgttgacattctaactcccaggatgatggtattaggaggtgaaactttgggaggtgattagatcatgcaggcagagtcctcttgaatggaattggtgccctcataaaagaggcctcagggagctagctcaccccttctaccatgtgaggacacagtgacaagttgccatctgtgaaccaggaagcaagtcctcaccagacgccaatctgctattgccttggtcgtggacttgccagcttccagaactgtgaaatataaaattctgttgtttataggccacctagttgcaagtattttgttacagccaccctgacacactgacagaggtatttcatgggtctcattagaaaatggatgaaaaaagagctaagtcaaagtttttacccccacgctatcttagtcagaattgctctgttttcatattttacgtgtggctattctctgtaaaatttgtttgaaaagaagttcaactgctaagaagaaaaaacatatttgaacagccctgctttatataataggtaagtgattgaacatgtggatatatttctctgtgcactgggaacacatagggaaatcatttgaaagaatattgctgcattctttgtaaaatcaatacctgtggattttcatgagtctgaaataattaagagtgtgtaggatgaacagcccttaagggtagtgttggggagcgggtggggcggatctggggaaggacattgtattgtttcgctgactgttttatgtcttagcaacaagacataacttagtacagcatcagagtccctcaggattacaaattacttgagggcagaaactcttttctgtagctccttcagctccctgtcgtgattctttaaatatttcatgtgcaaatgagtcaataaatggtaggaaggcagatagagcaggaaaattcttttccttcctattaactcttgtcccctactctttaaactcactgggctcggctctagacaatcaggtcaagtttatctttggcaccctttgctttagcaggcattccttttttccgagtgcccagtgtatcctcttacccagggttatttcactctcaaatcccagaaagggctatcttcccatatagtatctcatgcctcagacctttcctaatcctctaggagaggctctaggacctctaggcttccttgttatgagttctacttcttgctctctgtaaaaattttacagagttagcatcaggccacttagaggatgaagattacagagaagagagccttcaaactcttgtctctgcatgcaactggaatagaacactgcccaccatcgctcattgtatctaagcacttaaccccacccatgttgaacaacacttacctacctcccgagaccttttttcctcgaaggacagttttgtgtgatcccaggctcatttatttttaagggcaggtaagttacaaaaacatagggcatccttttcttgggttatcatatctcccactcctcatggctcaaagttactgtccttcaaatcgatatattgaaaaaagcatgagccactgccagagcagtcatttctctcccagtgtgtggttatcctggcctactttggctcacaggagtgaaggaaacaagctgcttgtttaaattatggagaatcaggctgggcatggtggctcacacctgtaatctcagcactttgggaagccgaggcaggtggatcacgtgacgtcaggagattgagaccagactggccaatggggtaaaaccctgtctctactaaaaatacaaaaattagttgggtggtagcacatgcctgtaatcccagctacttgggagactaaggtaggagaatcacttgaacccaggaggtggaggttgcagtgagccgagatcgtgccattgcactccagcctgggcaacaagagcaaaactgcgtctcaaaaaaaaaaaaaaaatatggagaatcagtactaaggagttactcctttagtttttcaaacaaatggtcatcatgtgcctgctatatactatacctattaacccactgtggtagattctgatataattaacttcttaatgtatcattttgttttctgtttactccttcagcaaaattctttagggaaacttatgtaactggttcagtaacaaaagcaaacaacactcaaacatacttaaaactcatgtagcttttaaaccactatctacaaatattttcagttttaaggcaaaaacaacttgagtaccaggtatgactacaaaataaagtgattattatcttttaacaacaaacataatagggtgtactcactcaaagatataatctcccctttaatgtagccaccatgagagtccatgcctttgttctattggtgtggcaacaactgcttgtcttttgggactaaaattagacattacttccttctttcaggaagctggccctcactcctaaagctgggtttcatgcccctcttctgggctcctgtgcttgcgtcagtcaaagcacttgtcatactggattatctttctccttcacctggctgagtgctccctgaagatagggaggatgtcttctgtggtttttgtacccctggggccaagcatgtacaggactagttgctcagtaaatatttgttagttgattgaaaaatatctctgcatcacatttttggaccatcttcaacaacagaaaattttcattcttttaatggagaatgatttttggaaaacaaatgttattcagaaacaagttgggcacataaggtattcatctagcttatttaaaaatgagttatgatcataatatattgaccacttttcttctctgattcatagactggctctgagaacaactccaaaggaggaattacaaaaggttctgaacaatagaagcttcccagggcaacatctt[144 bp omitted]gcctcccgagtagctaattttttgtatttttagtagagactgggcttcaccatgttagccaggatggtctcaatctcctgacctcataatccgcccgcctccgcctcccaaagtgctgggattacaggagtgagccaccgcacccggccagggcaacatctttgaaggactacattcatttatatgtttaagttacaacatgtgtctggagaatagtcaaataaatatttgccatgataattattgaatacatactctaggcagcagagcatacctttagaggttaagagcattactctggagctggactgcttgggttcaagtcctggctgtgcaatttatttagctgtatagccttggacaagttactcaaccagtgggtacctctgtttcctcatttgtaaaatgtagattaaacagtacttccctcctaagatcgttgtgagattaattgagtcaaccacgtaatatacttagaaatagggcctggtatatagaaagtgttcagtataggttattattgttatcatcattacatttatcattattactatgtttgaggtactgtgttagtaatactaaagatttaaaaaaggggctgggtgcagtcacacatgccttaatctcaacagtttggcaggtggagacaggcagattgcttgagctcaggagttcaagaccagactgagcaacataacaaaacccctgtctctacaaaaaatgcaaaaattagtcaggcatggtggcaaacctttaatcccaactacttgggaggctgaggcaggagaatcgcttgagcccaagaggcagaggctgcagtgagccttgattacgccactacactccagcctggcgactctgtctcaaaaaaaaaaaaagttccttccctcagtaagttcacagtcttatgaaaaatatacacatgtgatttatcttataatacaacttgatgagtgcccttagaaaagtcaactgtcattgtggggagggatctagtagtggtaacatctcagtagagttctgtaagtactgaatgccctccactcaattcaaaacagtgtgtcccaggaatatgaatgtcagtatagccagatacctgacattcatgatagtgatagcagcagaaagacctgactaaaattttttttttttttttctgagacggagtctcgctctgttgccaggctggagtacagtggcatcatctgggctcactgcaacctgtgcttccccggttcaagcgattctcctgctttagcctcccaagtagctgggactacaggtgcctgccaccacgcccagctaatttttgtatttgtagtagagacggggtttcaccatgttggccaggatggtctcgatctcttgacctcatgatctgcctgccttggtctcctaaagtgctgggattacaggtgtgaaccaccgcgcctggccccatttgttttttaaacaaagtaatgatatgtgatgttaatgcctgtgaaagtatttaatgtaccacgcatcgctctgaatagaatccattctggacagagaattcatagactctatcattaatatgtctctatcttttaaaaaaaaccaattccactttcaagaacaaagacataatgctgctctgatccttgaagtgaataatctagaagggcttgccactttaccaaaataacttacagctttactgtggattaaaattgaatcaaaatttaagaagagaattatttaataatgacataatctacatttgggaagtatattgtttctttcattactgtgtcatttattttactgtgcagaaaatatttttccttttttttttgaga[132 bp omitted]cacgccaggctaattttttgtatttttagtagagacagggtttcaccatgttagc[154 bp omitted]ttttctctctcagaagtagttatgaagatgacaatatatattgcaatcagctattttgtatgattcatgaagaaacacttcaaaaataactttgtaataaagacagaaaactgtttcttcacgattgtgattcatcataattatttttgaacatttggtaaatcttatttctgtggacttttttttcttgagacttgggtctcactctgttgccaaggctggagtgcagtagtgcaatcatggttcactacagccttgacctcctgggctcaagggattctcctgcctcagcctcctgagtagcttggaccacagacttgtaccaccatgcctggctattttttaatttttttgtagagatggggtctcgctatgttgcccaggctggtctccaactcttggctttaagccatcctcccacttcagcctcccaaagtactggaattacaggcatgagccactgcaccagactgtgaacttttaagaactttaaaaccctttcagggcttatttcaggccctcctttatgaattctgcaaaggcttcacttggtgaagaaaatggacttgaagtactaagtgtagtatgaaacaatgtggttacatatatgttcctgcacacttttcagtttctcttctgagaagttcaaagaagtcaagggattatttgggggaattaaagtaattgcaaagagaaatagtgtgggccagcaacccttccaaaatgacatgctgtgttctctgggcccaaggggcaagcaggaggtagggtgtttgttgaaagagttctctttcacaagagaagaaggtaaggttactatatcaattctttattttctttttatgagactgagtttcacttttgtcgcccaggctggagtgcaacggagtgatctcagctcactgcaacctccgcctcccgggttcaagcaattctcctgcctcagcctcccgagtagctgggattacaggtgcccgccaccacacctggctaatttttttttttgtatttttagtagagatggggtttcaccatgttggccatgctggtcttgaactcctgacctcaggtgatctgcccgccttggcctcccaaagtgctgggattgcaggcatgagccaccctgcccggccagttactatatcaattcttaagaagaaatctgtagtggagccccagatgtgttttcttctgaaagagaaacagaatatggcaatggtaattggggccatgtactatatttggcatttgttccaggtctacttagttaaactgaattttctgcttaaagtttggaattactattttggaagatgccactctaagttgtacagagcaagtacacagctgtcatctttatttcccctcaacagctattaacagtttatcctaaagtgatggattttattctgctacgtgaatcatgagtagtgtaatcataaagcgtattaatattgtgaggaaactctgcattctgagtatgtacatgattaacaccgtttctggacatgaataatgatgcctagggtttctgacctcacccagaacttcctaaagtttcagaaaatgaaattttcagcaactacaactactataatttctgttgtccttctaatatcaagacttaaaaaaaaatccaagcatgcactttcagtcatgattgctactttaggggtgcctgggtccttttcgtgttg[133 bp omitted]taaaaatatataaaaaaattagccgggcatggtggcagttgcctgtagttccagctactcaggaggccgaggcaggtgaatgccgtgaacccgggaggcagaagttgcagtgagctgaaatcgcgccactgcactccaccctcagcgacagagcaagactccatctcaaaaaaaaaaaaaaaaaaagaaatgccccacctaattctctctaggcaatgctcccacttcccaatcactattcctcctctatggtccctcagacgtaaaatatccaagtgtgggtatttgttccctcaaggccacaactcaatctttttaagcaaaagaagttcctctagaaagttcatgaatcatcacttgaaagtaaaatgttatgcattcggagtgggggtattcaaaggattctttcaattctcgaagagatcagtatcctcccccccaaaaaaattaagaaatatggtactaaggtctaatgcaatgaggttgatgtagtttcatttgaagattatttgtagtttagcagagagctcctggaaagaatgccttaacctaaagaaagaattctacaataaaggaaaagtaggctccagtggtggggaacgtattatttgggagaggattttggagtacttcaccacattgtatgggcaactaattattttttcttgctctgtctctttaatactgatgacaaagggatatctgtcttttatttcgccctgtagttatggtcctaacatatactaggatataatacattttaaaatgttaacacaagtgccaaaatggggtggggaagcattaagtccacttaactttagcaagcacttactgagcacctactatgtataaagcacagtgctaggtgatataggatagaaaggcaaataaaattctataaggtctgaaccttccagaacctgacaatccctaggagggggatagataggtgatataggatagaaagacaaataaaattctataaggtctgaactttccagaacctgacaatccctaggaggggtatagatagacacacacacacacacacacacacacacacacacacacacacacatacacgacagtacacacacatatatatatatatataaataatattaatgtaagacagactatgagatatgctattgcataatatgggagaaggcattgatgctaactagagagcacctaggaagctttaactaaaagtagaaacaaggctaccaaccctcaaatccctggacccttccccttctctgaacaactatcttcaacagattcagagattaggtccactgaactttaattttttctcttttttctttattatgaaatatttcagacctgcaaatggtatataaaaaccattataaatacccatgtgcataaatacccataacttaagcaagaaaatgttacagatatgttctcattgttcaattgccacctatgagtgagaatatgcattgggagatatacctaatgctagatgatgagttagtgggtgcagcgcaccagcatgtcacatgtatacatatgtaactaacctgcacattgtgcacatgtaccctaaaacttaaagtataataataaaaaaaaagaaagaaaatgttacagatatagttgaagtacccacacaactagaattattttactaacatcctctgcttttatttaaaaaaaaagtttttttttttttgagacggagtcttgctctgtcacccaggctggagtgcagtggcgcgatctcggctcactgcaacctccatctcccaggttcaagcaattctcctgc[134 bp omitted]cggcctcccaaagtgctgggattacaggtgtgagctgctgtgccccgccatcctctgcttttactagcagctttgaaagatgaccctcaatgaaccctgtcttctggtattcatgcccttgtgtcatccccctcccccgactgtggctggacttagcgacttgcttctaatgaataaaatatgacaaaagttgtgggatgtcagttctgtaattaggttgcaaaagactttgacttccatcctgccagcactctcactcgttcattctgatgaagcctgctgccacgttgtgagatgctctatggggtggcccacatggcaaggaatcaagggaagcctctagccaacaccttgtgaagaactgagtccttcgtccaacagcccacaaagagccaaatcctgacaacaaccatgtgagtgaacttggaagcagatcctcctggttaagtcttcaggtaagactgaacccctggctgacaccttgattgcagccttggaagaaaccctgaaacaaaagactcagcgaagccatgtctggattatgttttgagctcctgaattttggggtaatttgttaatttgttatgcaatatgaactaatataccttccaagaagtaaccactgtcctaaatgtgctgtttatcattctcatacgtgtgtgtgtgtgtgtatatatatatatatatttgtatgatcattcccatgcatgtgtatatatataaattgattaaatgtttttattccagtctgccatggaagaagcatatataagttgtattaaatgttttaaaaatccatataagtgccattacaatatttgtatccctctggaactagcttttcccttattcatttttctactgccaccactcaatctttgctcttccaagaggtctttctctcacagcccctgtgacttctagtctcctccccagcccagcctttggtgttctattcagtttatgtgcaacagtcccaagccattgaattaagcctggtcataccttaaacgaagctcagcttcttcccatattgctctctaaaccaaaatctgggcctaggctctttaatattacatgggcttctaggcttatctggatcatcactttggttttctttgataatgctgctttccatagcagtgtgcatgttaaagtttaagtgtacaggaattacttgtggatcttgttaaagtgcgattgtgattcactaggtgtgcagagggcctgagactctgcatttccaaaacactttcaggtgttgctgatgctgctgatacgtggaccacatatttagtagcaaggttctagaagatagacatccatctctgtctttgcagaaattgttttaacttggtattttaatttatatagttcagcaataaaggaacttaacataagcttacccaatgattgaatgtgatagctttcaaagaagggaaggtaggccaaaacaaaaacaaataatgtaaggaaacattttactcagtgttatttacctaaagcaagtgaaaagaagagaaaaattagagtgaaaattaacagactagataatagaaaaacaatagagaaaaatcactgaaactaaaagctgcttcttggaaaaaaattaacaaaattgtcaaacctttagctacattgaccaagaagaaaagagagaagactcaaattactgttaccaaaacacccgaggtttggtctagatcctgctgctcctggcacagaaagccagtcactgagacaatgagtattgccaaggaagaaggctttaatggagtgggggtgaggggtgctgcagttgaggagttgggagatgagtctcaattccatcttcctggctgactaatattaggggtttatttagtggggaagaaatgtaactgtgtgggaaatcaggaactagggaggggtaaggaagcaatcatgaggaatgaggggtctggcacttcattgtctggatatggtgatctgttgagtttcagttcttcgatactttttgagaggcctggggatcttttcctgaggaaggaacgcaaatgaaacaaatggaagtttcaagctttaagaacagaagggtcaatttctatgtttatccacaaaaactgtctctgggactattgggttggtttcattgatagaattagaaattaaagagggaacattactactgactttacagaaataaaatggattataaagaaatactattaacaactggacatcaataattagataaaatgaaaaaattcctagaaagatgaaaactactgaaactgactcaagaagaaaaaactaatatcaatatacctatcgcaagtgaacagattgaattagtaattttaaaaaactacccacaaagaaaactctaggcccagatagttcaacactgagttctaacaaacatttaaagaagagttaatttagcctggcgcagtggctcacacctgtaatcccagcactttgggaagccaa[131 bp omitted]cgaggcgggcgatcatgaagtcaggagatcaatatcatcctggctaacacggtgaaaccccatctctactaaaaatataaaaaaaaattagctgggcgtggtagcgggcgcctatagtcacagacactcaggaggctgaggccagagaatggtgtcaacctgggaagtggagcttgcagtgagccgagatggcaccactgcactctagtctgggcgacacagtgagactccatctcaaaaatataaataaataaaataaaataaaataaaataaaaattagctgggcatggtggcaggctcctgtaagcctgtaatcccagctagtcgggaggctgaggcaggagaatcgcttgaacccgggaggcagaggttgcagtgagccgagatcctgccactgcactgcagcccgggagacagtgctagactccctctcaaaaaaaaaaaagttaatttaacaccagttcatcacaaagtatcccaaaatagacgatgatggaactcttcccaactcattctgtgagaccaatattaccttgataccaaaatcagataaagatatcacaggaaaagaatactaaagatcagtaacttttatgaatatggatgcaaaaatccaaaacaaaatactagaaagctgaaaccaacaacgcaaagaaaacaatgcagtatgaaaagtgggatttggctgggcacaatggctcacgcctgtaatctcagcactgtgggcggctgaggcgggcagatcacctgaggtcaggagttcgagaccagcctgtccaacatggtgaaatgtactaaaaatacaaaatgtactataaatacaaaaattagctggtcgtgttggcgcgcacctgtagtcccagctacttgggaggctgaggcaggagaagcacttgaacctgggaggcagaggttgcagtaagctgagatcacatcactgccctccagtctaggtagcagagtgagactctgtctcaaaaaaaaaaaaaaagaagaaagaaagaaaagtgggatttatcctcggaatataaagttggtttaacatctgaaaatcaatataccatagcaattgaataaaaactaaaattcacatgatcacctcaatagatgcagaaaaagcatttgacaggctgggtgcggtggctcacacgtgtaatcccagcactttgggaggccaaggcaggtggatcacttgaggtcaggagtttgagaccagcctgatgaacatagtgaaaccctgtctctactaaaaaatacaaaaattagccaggcgtggtggtgggcgcctgtaatccaagctactcaggaggctgaggcaggagaattgctcgaacccgggaggcggaggctgcagtgagcctgccactgcagcactccagcctgggtgacagagtgaaactccataaaaaaaaaatagcatttgacaaaatccaatacccaattctctttcatgataacaatattcaacaaactagcaacagtagggaactccctcaacttgataaagggcaactaggaaaaatcacagctgacactatacttaatgatgaaagaatgaatgacttactcttaagattaggaacaaaacaaggatgtcagcatctcaacattgtattgggagttctattcagggcaattaggcaagaaaaagaaatacaagccacctagactggaaaagaaaaaagtaaaagtatctgtgtttgcagataacacgatcttgtatgtagaaaatcccaaggaatccacaaaaaaaaaggtcaatcaaggttgcaggatataagatcaatatataaaaatcaactgtttatctatatacttgcaataaacaataaaaaatgagattaaggaaaacaattccatttacaatatcatcaaaaagaataaaatacttaggaataaatttaagaaaaggagtacgaaaattatgctgtgaaaactacaaggcaatgttgaaagaaattaaagaaggtataaataaatggaaacacattctatgttcataggtcaggagacttaatattgttaaaatggtaatacttcccaaagtaatcaacatattcaatgcaatctttataagatcccagctagtttttctttagaaattggcaagatggctgggtgcagtggctaacacctgtaatcccagaactttgggaggctgaggcgggtagatcagaaggtcaagagattgagaccatcctggccaacatggtgaaagcccgtctctactaaaaatacaaaaattagctgggcgtggcgttgtgtgcctgtaatcgcagctactcgggaggctgaggcaggagaatcgcttgaacctgggaggcggaggttgcagtgagccaagtttgcaccactgcactccagcctggtgacagagcgagactccgtcaaaaaaaaaaaaaaaagaagaagaagaaagaaagaatgaatttggcaagctgattccaaaattcatatggaattgcaagtgacccagaatacttaaaacaatctggaaaaagaagaacaaagtagaaggactcacatttcctgatttcaaattttacaacaaacggtaatcaagacagtgcagtagtggtataaggatatatggcatagaattgaaagtccagaaataaaaccatgtgtctatggtcaactgattttgacaagagtgtcaagaccattcaatgagaaaagaatagtgttttcaacaaatagtgctgggacaactgcatagccacacagaaaagaatgacgttggatcatgccccacactatatataaaaatgaactcaaatggatcaaaaacctaaatatggccgggtgcggtggctcatgcctgtaatcccagcactttgggaggccaagaagggtgaatcacctgaggtcaagagtttgagaccagcctggccaacatggtgaaaccccgtctctactaaaattacaaaaattagccgggtatggtggtgggcgcctgtaattccagctacccaggaggctgaggcaggagaatcgcttgaacccgggaggtgcaggttgcagtgagccgagacgttttcattgcactctagcctgggcaacaaagagcaaaactccgtaaaaaacaaacaaacaacaacaaaaaaaccccataagattaaatgttcatgacctcagctttggcaaggaattgttatttatgataccaaaaggacaagcaacaaaataaaaaatagataaatttgatctcttcaaaatgtaaaacaaggacaccatcatgaaagtgaaaagtcaacccacagaatgggggaaatattttcagttcattaataagggagtggtatctagactatataaaaacccaataataaaaagaaaaaccaattaaaaatgggcaaaggatctgaatagacatttctttggggaagaagtacaaatggacaataaacacatgaaaagttgctcaacatcatcagggagatgcaaggcaaaattacaatgagacaccacttcatacccatgaggatgactataattaaaaagtcagataacaagtatgggcaaggatgtggagaaattagaatcgtcctacattgctgacaggaaggttaaatgatgcagccactttggaagacagtctggcagttcgtgaaaagtttaaacagaaagttgtcatatgaaccagcaattccccttctaggtatatacccaagagtaaggaaaatatatgtccacacaaaaacttatacagaaattgtacaggagtgtttatagcagcatccttcataataaccaaaaggtgaaaacaacacaaatgtccatcaactgatgaatgaatagacacaatgtggtatctccatacagtggtatattatttggccataaaaagaatgaagtacttactgatacatgctacgacatggataaaccttgaaaacattacatggagtaaaagaacccagatacaaaaaccacatattgtatgattccattaatttgaaagtccagaatagggaaatctaaacagacagaaagtagattgttgctcagggctgaagggaatagggaataaaacagcgatagccaaagggcatgggatttccttttgaggtgatgaaaatgttccaaaattggtaatggttgcagtatctgtgaatatactaaaaccactgaattctacattttaagtgggtgaattgtatggtatgtgagttatagcacaataaagctgttaaaaaaaataacctgggacattcatagggctcaccttgtttatttcccatcttcctgggatcaccatccttagttacctactattaatatctagtgacttgaaaacttgcttcatgttgtctgtctttatttgattttatttggttgtttcattcaggagggtaactacaaaccctgttgctccatcttagccagaagtggaagtctccctatttcttaactggagaaactgagtcagctaactggcttgccaaagttcacatcagtcaggactataaccaatatttcctgacttctaatctgcagttgagacagaattgtttcttggctaacttccaggacaacttgatagcagaaagtcgattaatccggcatagaaaaaggaaatatgtgtgacttgacaatccctggaaggttcagatcagttatctgccttcccctcaatcaagcaagtatttgccacatacctatgcacaatgtcttttgggagacactgccgggaatagagaagtcagtgctagcatctctggcaacagggggatcaccatctatttgggagaaaaagctacacatgaaacatctctgtgactcaaatgactcaaccatgtttacctataatataatgacttactcaactatgcagtcaagagagtcaggaaaggtcacagtgtgtggccttttctcaagaaaggcttcccagaggaggagggacttgggcttcaaaagataggcagcatactctgtctgggtagggcagtaaaggcaggacattgtctccacaggacttatgtcaaaatgcacgaggcctcagagggttcttggctgtaaaaaacaaacaaacaaaaaaaaaaaaaacttgagccttgtggtaaggaggaaggaaggggatattgtcctgtccagaggacagacctagaggacagtcctagaagatttaatggaagttctatggtgaggaggatgacgaataaggcatctttatgcctaccgcaaaatcaaatcctcctaggtagacagttttcattgaaagcaaaaagtgtcttcccaggtcatgaagagcagggctgtccactcgaagctgcaggacaaacactctagactctactcattcaatcatgcagtgaacatgtattgagcatctactatacgcctgaagttgtgttaggggctggggactcacagttgcctaagacttgtggcttgccccagtttagtctagatgagaagacagacatttggatgatgatgacaattttccttagggaaaggtgctctctttccccaccctactccctctgtcagtcaacagaagtggccaagtcctttccatttgcagaccaacatcagggtcagggtgggacagagggagagacctaaagccacaacaacccacagaggtttccacttaatgttgggataacaggcaacacccctggaagaccagcccaaagatctactttacagcctgtctcaaaactcagggcctccaggcagcctacttttctatatctgccccctaccaccctcaccagaggccatcctgaatgacagtgatatgtgtggatatggtttagctcccctaagaaaggccctttagggggaacgcccaggcctgcctcaagtttgtaacacccacggagcctgccacagggctctgcaccaggtcagtgtttggtaaatgcttgctgaatgactcaaagggctttggaatcactatcaccatgaatggtgtttctcttctacctgcctagggcttgactgtctacaaagggccttgctatcccctcttcctttttcttaggatcatttccctggcctcacttgaggtttctgctcttccggcctagtgtgattctgctgtgaggctggggacaatgagggatctcacccctcaggggagaccctgcgcccgccccccacatacagggagtgacttggtcccttgctggcctcctagtctactgtgtcacagccaaagcaggctgtgggcactctccaaagagaaacaccagtgcaggagtgccatctccctccaggtggggtagggcccctggtcctcaagcccagtgcttcctgctgctcctggaagccacgggaggggtgggggacagtgtggaatgctggtctctcttgggatttgaccttcactcccacatcccatgggggtcactgcacaggctctgtgaccttgagctcagcccctgggagtggagttgcctgtcagggctccatccttcctgttgagcaggaactgcagccccactgggccctgattctgggcaagtctgcaccaccacaggctccttttcacttacaggctaacctagcttgtgggattcgaagaaagattattatcattaataccctctgtgtgtgcagggccttgccattcacagcaacacttcttcatcatcttattgatgtctcaggataggcatatcagttgggtttttcataaactgtaatttcatctccttcctcagtcattttttcccttcctactggttttctaactcagtgagtggccctccccctccaaaagtatattagcagtacaagtgtctcagaaaaaaacaaacatacccatgtatcttggttgacactttgagtctgataacaccatgctcagcaattacagggcagggacacactccctggtgagcaaacagtagagttcagggaaaatcgctatcaagtataagtgtattatgaggtcagagaccaatttaccaaatagattgatgacagagttgctattcacagtttgaaagtgcagttattttaaaagacattcataaagttattgaatttgagtgagtatgcacttgtgtattctattcccctgggttttctgatacaagtttataaaaagaaagtgactagttacatcccacagctaattagtggtctgggctaggacgcaagcccatttttctttcctgagccttggcctgtttatatgagcctccctggaatggaagcgtttgcttacaggctgcccattaaatgctaaaagtaaaatagaagataaaagagtgacttgaagctcaagtattccaaaacatagtacactgatgaccagttcaacatttagataaagtactatagctctgaaatgaatatttgcttcatagcagtcaatggggaaatgggacttgaattccttgaagtggctttacatacaaagatctagcaacccatctaacagcatcttctgaagaagtgaacaaaagatgtcaaggtggaaagccagggtcctgaccaaattctttaggctgtgagacctcgtacaaatcacttagcctaggatcctcaacttccattgatgttaatatctaagttactaccaaagagaatcaattgaggtcatccagtcagtctccacatctgctctgtcttatccctaaattcctcttttctccatcctctgttctctccttagctgagtcctcttcattttgctctctacactgtagccaaagagatcttttgaaaaggcaaacccagttacgtagctcatctgctcaaaacccttcaataggtctctgttattatcataataaaaatcccaattccttaccctggtctacaaggcctttcatgatctggcacctgctggtttctctggactcatcccacactactactccctcttaaatcctaggctctagccataattaacagctgttcctgagtaagccagcttctctcacctccagcctttgcactagcttcttcttgttcccagaacactcagtgccttccagctcccactcccccttttcttcttctaaccctgtaatattctgtatctatattacccacctgggaaaccctcccccagtctgaactgctcttcctctgtgtctcccccgtcacacccccgcagcaccctatgcttctgtcttcttaacactcctcagcctgattaaacggcctttttttccttgttgatttctcccactcacttctgcaggactgtgtcttactcatcattatgtccccagtggagctcgttgaatgaatgatgcatgtttaaatgctttgtaaactgcaacttgctacacaagtgttaagtattatgtaacgttattgtgttcagattgcttgcttagttattgttggcatactcacccatttgataataaagaatataatatttcaagcacattattttggctccttcttaagcccaatagtaataaaggctaccacttattgagcacttaacctggtctaggctctgcagtaagattttacatgtacaatctcatttacttatcattatagcaatcttataagcaaggttctattatgagcgtcatccctatttttcagatgaaaacacagcttgcccaatgttacacagccagattttgaatccagatttttcaagttcaagatccatgccctgccaaagtcttcatataagagaactatcaacagagtgaaaagacaactcacagaatgggagaaaatatttgcaaatcacatagccagtaagggatcaatatccagaatatatagagaactcctaaaactca[277 bp omitted]ggcctcccaaaacactgggattacaggcgtgagccaccgcgcccggccagcaattgttttcttaaaaaaacaaactgattaaaaaatgggaaaaggcttgaatagtcctttctccaaagatgatatgaaaatggcaaaaaagcacatgaaaagatgtttaacatcactaatcattagggagatgcaaatcaaaaccacaatgagatattactcacactcattatgatggctactattaaaaaaaaacaaaacagaaaacaaaaagaattggccagcatatggagaaattggaacccttacgcattgctggtgggaatgcagaatagtgcagcctctgtagaaagcagtgtgttggttcctcaaaaaataaaaagtaaaaaaaatagaaggacagtgtgaaccagcaattccattgctgggtatatacccaaaagaattaaaatcagggtctcaaagacatatttgtatacccatgttcatagcagcagtattcacaataaccagaaagcagaagtaacctgtgtccatcaacagacgaattaataaacaaatgtgagatttacgtgcaatggaatattattcagccttaaaaaggaaggaaattcttgcggccgggtgacacggttcatgcctgtaatcctagcactttgggaggccaaggcaggcagattggctgagctcaggagttcgagactagtctgggcaacacggtgaaactccgtctctactaaaaaatacaaaaaataagccaggcatggcagtgtgcacctgtaaacccagctactcgggaggctaaggcaggagaatggcttaaacccaggaagcgaaagttgcagtgaactgaggttgcgccattgcactccagactgggcgatagagcgagactccgtctccaaaataaaaaggaaggaaattctcatatgctacaacatggatgaaccttgaggacattatgctaagtgaaataagccagttggaaaaagacacatattgtatgaatcttcttctttgagctgcttagagtagtccaattgatagagacagaaagtagaatggtgacttaccaggggattggcagaaaacagaatggggaattaatgttgaacgggtatagaattttggttttacaagatgaaaaaagttctggagatggatgaatgatgacgatggttgcacaacaatgtgaatgtatttaatgccactgatcatgcacttaaaagtggttaaatgataaattttatgttatgtatattttactacaatttaataaaaagatccaagccctgattctaaccatttctcagtcctgccaaagccttcagataatttgctcctgatgaatgtttgctgctttccctccagataacctgccttttgtttctttttcctcccatgaccagactgctctgtctggtcctctagagcctccacattggtgagtgtctctgaagagggcagggcccaggctcaagcctcctgcccactctcctcttgggaagaaaatgcttactctgagagcagccagcgcaaattttactcataacaattaacagatggctgtgcatcccttctgttcccaggaatcacatctcacatcgggactaactgcactgtgcattttccatcactggtaactaattccaacagtgacgctgggcattgttattcatcggtgaagaacagacataaagagagaggggaagtggcttgggctgagtcacatagcaaagttagaactccaacctcccagcaactaaccttgccctgggctctgtcccacacacctggcagctcaagacttgctcctttttgcactctgggcgacagactccctggctaaccaagcgcgtctaacttgtcttgcagagaaattaagcgaaatcttccttgggatagtatcttgccatctttcttttcttagtggttgacaggccagtatctccactactgctgaatgaccttgtgcacatcattgaaagtctctggactctcagtttacccttcagtaaaatgtagggaagaattattaatgccactaccaggggaactgaggatgaggtagggagggaagaatcggggtaaactcctccagtgtattctgcatcatcctttacatgggtgaacatcaaatttaactga[139 bp omitted]catggcaaaacctcgtctctactaaaaatacaaaaattagccgggtgtggtggtgcatgcctgtaatcccagctactcgggaggctgaggcaggagaatcgcttgaacctgggacacagaggttgcagtgagctgagatcctgtcactgcacttgaccagtccagcttacttggaattctctttttcctgggccacctatcccccaatataaaggaagtcccctggtattgagccgcaggatggtctcacttctctatttaaatcctctccaacctagcttaaaagcaccttttccatgagactgcattgcagtctgtcccctttgagggcttccgtggacacactgttcccttaattttggcacttcttacagactgcctgttattttttaaatctttgtctcttgtttcctcagttagctactagaggataaggactgtgtcacatcctattattgccctacaaatgccaactccattagcacatagtatatgctcgataaatatttgctgaactgatgaaaatcttgtaggtgggaaatctgaaataatttcttacaataagtaataagaaggagatacgggagttcgaaaccagcctgaccagcatggagaaatcttgtctctactaaaataatacaaaatcagctgggcgcggtggcacatgcttgtaatcccagctactcaggaggctgaggcaggagaatcacttgaatccagtaggcgcagtttgcagtgagccaagatcacgacattgcactccagcctgagcaacaggagcgaaactctgtctcaaaaaaaaaaaaaaagaaggagatgttctgtgctctttagctttctgatcatatgaaaaaaaaaattttataaacaaagagatatgagccctagcttccaatttggctgtatcaaattcattatgacctgtggcaagtcacttgccttctctagtgttcagtggcctcatttgtgaaaccagagctgatgtgtaagctaactttccttccttccttccttccttttctttcctttttttttttttttttttttttttgaaacagagtcttgctttgtcgcccaggctggagtgcaatggtgcgatcttggctcactgtaacctccacttcctgggttcaagcaattctcctgcctgagactcctcagtagctgggattacaggcacgcgccaccactcccgctaatttatttttttaattcttagtagagatgggggttcaccatgttggtcaggttggtcctgaactcctggcctcaagtgatccacccacctcggcctcccaaagttctgggattacaggcgtgagccaccatgcccggctaaactttcttttagttgtgggttttggctactctgtatagcaaggagcggtcttgctttccatatcaataccattaatgtccatggttcctttttttccccctgtaaggactgcagatttatgggtcaccccagtttataaaatgagaatatcagatacagaacaaatgtgtgctttggccaagcttccaggcatagagtgtgtgcatgtgtatgtgtgtgcggggttgcttacaccttactacaggtctctggcttcgaatggactctttcgtcccagagttgctcagcaggcctttccaagtacaggactgtcaaccatttgttgtttgtgtgcccagtctctgctttgtgaatgaccacagtgcatggcattccaactgtttcctcttgtccctctgcacactcctagggccagaatgtccactggcatgttcagtaagatctgttcaagcactgtcctgcttatgtcactggaggagatataagacaccagtccttgccctctgaagcttctagcctacatgggaagccagtacaaggatgtgtgtatgtggggaaagatgcactatcataagtgagggagagcctgggagttatgtgctgcttttttttttttttttttttgacagagtctctcactctgtcgcccagactggagtgcagtggcgtgatcttggctcactgcaacctctgcttcctggcttcaaaccgttctcctgcctcagacttc[133 bp omitted]agccatcacacccggctgctgctttgatgtgtctccagtatctagaacagtccttggtatgtggaagatgcccaacaaatatatgaaaatgtgtgaaaattgctatggttttcaaacttgatattgtaagggacagcttttcttcaaagaaatcatacctggaggctcagttatgtgaaacagatggatacaatactgccctgcttgaggggagctagggtcaaagcctgtctgcttgtctcctctgagccccaaagagattcttgagagtccagttggaaaactactagttgaaaatgaggggcagctcaatccttgctctctcttcttggttaaccttagccacaaggtgatcctagcaaaataaatggaggtttaaagaaccttacactccaaagggaatatttgcacctgaaaaagatggtgttaatctcccccttcccctcattccaggggggctccaattagtaagagcagagggaaggaaattctgagtaggagacttctgaattggttcaacaatgtctatcaatgtaatggtaatatttgtttaacttaaacaaacaaagaaagaaaaccactgtgataatgtttttcagcattcaatagaaacccacttggtgttgtcctacaggcagtcttgattacaatgtaaaactccctgtggagtctggtcagtgagtagctggtactgccatttacaccagagtacctcgcattatccagactgctattcacattcctgaccaagttcacggtcaacctcctgcactggcagccaagagggcctgcctggagagagcttctcttctccatgcctgcaggactgtgactctctacctgacctggccctctcttagccttcctaccataacagggcaagggaggggaatcaacccaggggatattcccttgtcaaggtcatccacggagcaaagcacatcccagatttgcatctaggaaacaattttgggtaacagacatatatatatatattttagatatgtcaaaggggtaaagctcttgaattaagatggtttcatcattatctatctcatgaatctctaccttccccaacgactgtccttcctcacagatgcctgaaggggcaggcagataattagtgctggggacctcatttgatagtaggggaaactgagaggtgaaaagagctcccttcagttagatagcaactcaccaggaactccagtttctcccctactgcttggtatggccacctcctccacctcttagccagtcctccgacttctacatcttaaaaatctagctcaggggccaggcgcggtggctcacacctgtaattccagcactttgggaggctgaggc[132 bp omitted]gaggcaggagaatcacttgaacctgggaggcggaggttgtggtgagctgagatcgttccattgcactccagcctgggcaacaatagccaaactccatctcaaaaaaaaaaaaaaaatctagctcaggtctgaccccgactaaatggacaatcttccattgatttcccatcccctcaaccccggttcaagccaccatccacagcatttggactagtcatttgtacttaagtaactgagttagtatcatgaaatttggtcttaggatcaaagccactcaaggttagagctggagggaaccttggagattaagagaaactaaggtttggagaacctacctaaggtttcatagcaaatatgtgacaaatccaaggcttcaagccaagttttccaatgtgtccctcgtgctttcctgactacatctggagtttctctatttcttcttctccttctccttcttcttcattttttttttttttcgtgtgtgtgtcttttttcccctatgtgatgcttcctttctgccctgtgaccctctccctctgtcctgtcttattagaaagaggctctagagctggctgcatagtacctgttctctgggaccttggtgttgatctaagactggtttaactacctaaagagaagcagagacccgagggggcctgccataacccaactctgaaacatgacttaatcccaagtaagatcagctctaacatttgttcagaagcaaaaatgatggattctaaagtttgacttccccaaggtcatctggctaagaggtggctgcagcagggggcaacaataggtcttcaggcccctggggcggcaacctggcactgcccaagagcccgcaggctctgaaggccaactgagccagcggcaagcctagtccctgcctccctgcttggagcagtgcgactataccgttttctgtctgctcatttgtgagcttggttcccgtcctaaatgtgggggttcaaggcagacaaagagtgtgcagttggccaccccgctcgccttcaggaagtgtgtaggacaccgtcgaggccccctagccattgtaaaccaggcgctgaggctcgtgcccagttgtacccttcccgcgcagcgctcaggagcgacaaacctggaggctattcggtctgccactgggctgtgccgggattcgcggactttctcctgaatagcgctctcagctcgcgtcttccccctgccactctcccacgcccccagagtacccaccgaccccagcaggccgggtacatccctgccgcgcccatccggccagtggctccaggggccggcctggtgtgtctccagctgggcgcctaccgcctgccccagcgctagttctggcgttgggggtagagaggtaaagaggggagttagcggggcatctccctcccagggctgagccggcaagcgcatcttctccgcgagttcctcactgtccagcgagcgctgcccaacttctgcgccggtgggacccgctgctctgagtcactcttggcacagaacaccaagcaccctcagaaaccgaattcaccacctttgggaggctcctgggagaaggcaaggaacccaggcggggctcccagggctctcgggctgggactgggttgtgtgtgtgtgggggggcttcacggatacccctcccaacctgcttcctttccctgacagcagccatctcccccaagagggagagtcttaggcgtcccggaagaccctgcggactgtgcacctcgaggtaccagcctctcctgggaggagtggggggccgctggtcagcggctggcagaggggacctgtttgctggcccgtttggaggtgggatggagtggggtttggagactgagaagcccaagagaagacactgagtttctccccaccccacaaccccacttccgaaaaagaaccaggtggtgaggaggaataaggcgaagtgtaaacacaaacaacctcaaaaagaagccaagaaaagcgaagcccaaagaagcaagagcaacactgttacaaaactgtctggttttgtaacaatttccccgccgccggccaatgaacagcgtggcggcacgtcacgtggtaccgttttatataacactttgctgagacaagacagttattaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgggcacgcaagcaagccctgagcacacccctggggaaaaaaaaaacatcaaagcctgttgccacagaggaagctagatcccagatcttggggaagagcagggcaatatgaatgaggcaggtggaggtcacttaactctagatctctaaggcagattccataccttttagccatcccccaggggccaggaaagccccttcctgccctcacccttctcctctgttgccaccacattcccctggaagttcttccttgcatctttgttaatcccctcagagaagtcagggtgaaaatgtcaaggccagctttacccttctaagaggaaaggaggctctctgttctggaagatggccattgtgtccgtattattccaagtactgcacacaccttcagaaaaaggaacctgctccccacatcccagcttcaaagcttcaaagtctgaccagttatcagtgactgcccagctagccgtgtgaccttgagaaaatgccttcccttctctgggcttgattttcccatctgaagaatgggttgattgagccagataatctctaatagcctgtccagctctgacatctagtaattcagagtttttggtgagagccggcctcaccttattcccagaaaccttgtccaagttcatttacatttggccatttgaaatgagaggatgggaccatgtaaatgtatttccattttcttcaagaaatcttcatatgtgctgggctttgtagacaaaggtgttactaatgtcatcagtcattcccacctggaaaagtaacttggatttgtcttcttggtggttcagataggggtcacatctgcccacctctctctccttcctacctggcctgttttcttgttggtaatactgcactcataaaccaggctgccggacactagccgtgtgtagccacatctcgcctatgtcaaagtgtctaatgcaccactgacaccacggggcctctaatgaaccacttgtgagcgggggcaaaaatgactttgcagttggggaacctcaggcccagagtggctgggggtatagaaggcaggacaatattaggactagaaatagagcctaacccttttgatctccagtagaaaagtcctagaaaacttatcatttgctcaagatccatactcatacaggacttaacacctgcttgcgctgggggccattaataaaggtttttctttcttattttgacagctccaaatgaccacttgctttatagcaatcggtctcagatttatttcaccttggagtctcatgagaatgcactgcatgatgcagaaatagcatgtaagctccgcccgatgggttttaaggtgagtgtgggatggaagaggtgggaaggggttgtactgtagacaggtattggcaggaagggctgcctccctggagcataggggcactagagctcaagcagaacaggaagaagactttgcaaaggagccagggtaaagatccctgggcaaagagtgactcaggtctgcaagggagctggattcttccccaattcagtcttcaactcatgaccttcagagcagcctgggcatagtgactctctagaatatgcacttgggagccagactgcctgggtttatgtcccaactctgctaacttttatgacctttgtggccctgggcaaatgacttaacttcccagtacttcatctcctcatctgttaaatgggggatattcaaagcagctactaaagagggctgttgtgaggattacataagctaataatgtaaggtacttagaacagtgtctggcatgtagcactatataaacgttctctttcttcccttccttccttccttccttcctttctctctctctctctttctgttttctttcttttttttttttttttttttgagacagagtttccctctcgcacccaggctggagtgcagtggcgcaatctcggctcactgcaacctccgcctcctgggttcacgccattctcctgcctcagcctcctgagtagttgggactacaggcgcccgccaccac[187 bp omitted]gtgcagtggcgtgatctcagctcactgcaacctccgtctcccaggttcaagtgagtctcccaccttagcctcccgagtagctgggatcacaggcgtgtgccaccatgcccggctaattttttgtatttttagtagtgacggggttttgccatgttggctggtctcaaactcctggcctcaagcaatccacttgcctcagtctcccaaaatgctgggattacaggtgtgagccaccgtgtccagcctatataaatgttttctatcgccatttttatcattttccagggacattagaaagaggaaggtgagagtggtgttgctgccctggtgctcctgaacctctactgataggctccttggcagcttggccagttttctctgaagggatcctcacactcacacaatggttgtgccatttcaagtccttaatatagtcagtcagcctgccagtatccccaaggatttaggtcacatggggggtgagaagaaaaacggcctggacacctctcaggatgccaggatgcaaagtgtcactttctgtatctttgcctggcttcaggactggccctcagccacatgtcagtactttgtttagaagattagatttgagcctgtgctctactacttgcaaaccatggggaggtggcttcactctctgaaccccaagtatccttgtttgcaaaatgaagctattgatatctgccctgattgcctcgcaatgatgcaatgagggtcaaaagtgaacgtggccaagaggacattctgcaagctataaagcttcctggatgtagtgctctgtctctacacaacccaaggatgccttcctcagaaaaccaatgtatccaagttcaagtccatgatcccttatctgaatcttgtaagaccagaggtgttcagaatccagaatgttttatattttgcaaggaccatatattaggtctcagtgagctctggacagcttcctgtaatccaacacactattcagcagattccatgaaaattcacactcagtgggacaaatatttttaaacactttatatcagtttaggtcaggttttgccatctaatgaattttgatgtcaagcttatgaaaataatggattatcagaacttttttggatctggaaaccagataaagcatgtggacctgtgtactgtgcaatgaatgtcaggtgaatcttgtatgttctttcttgagaaggttttcatgagtgatgatggattcatttttttttctgagaaggttttcttgagtaatgatggattagtatggttttttttccccaaagaacacatttagtgtttaatacaagtcaccagtgtcttaacccaaaggagctttagtgggggcactttcagcctcccagtagtgcaagtcagggagctgcctaggagtaagaggacttgcaactctttccacctccaccctaagcctagatcctagggctaaggaacttgatagtgtggtgagaagcagagctgagaagcagtgaagcattttggatgaaatgggaaaagtgacttctccagtgaaggaagagttgatgaaagtattaaataggagtttcatttccccatagtgatgaagtgagaggtgggggcagtgatgagataatttattttcttggaggttaagagaagacgaactgatgcctataattcaaaaccacctcccaccctgatttgcatatttcccaacatttctatgtaaaatgccccaagtgtaggggtttatctggcagccctattctctattccagccatccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggtggaggttgtagtgagccgagatccaccactgcactccagcctgggtgacagagcaagattctatctcaaaaaaaaaaaaaaaagagtatatggattgctacttgataatatgattagtgggatcacacagaggcctttccagtctcccaacacttctcccctctagctgccctgtgatatcatgcaagcctttcccaaacacccttggtaaacactgctgggagaagcaacaagggaggccatcaacatccatgtatcagccaagacaaggcttcagaaggagctgggggaatgcggaaaggtcttcaagaggtttggagcaggggccactgctcaagaaggcagcttcagggcagcctctgcagcgaggccatagcctgagggctctggggcctgcaaagaggcatgttagaaaggggggcaggggagtatccagcagccacaacctggatcacttcattcactaagttaggcttagtactgccaatggaggaggcaagggagcaggccactgggtggagggacgtcctagatgactcaagtgaaatgctcttcaagccaagttgctagtgtccacctgtctcaagacacacacagagggcagccctctcccccgctactcttttttcttccttcttccccaggatgttcctctgccctccctagagtgtctttcccagagcagttgggcttgggccctgaggagccataaacttctttatactttctaaagtatgtggtgagggagcagaagtgatccaggcccctaggagagtaagctcagcccctggttagccctctgaagggcagtctgctttgtggagaagagcattctgggagtcctgagactgcagttctagttccagctttgccactagcgacctttgaggtcttggagaggtcagatcccttctcctgggcctcttctgaaaactgatcagttagtgtaggtgctctttcaagccactactgaggactggttctctgcttgagagactagttcaaacgaacgcatacctgggcaggccctgaaagctggttagcatgtggtcaaatgggggttcttgctacatttgatggtcactccgtacaatggtggggcagagacaaggtagtatggcagagtggttaagaatacaggctttggtatcagtcagtcccaggttcaaaccctgattccacaatttaccagctgtgttacactgggcaagttaacgtttttgggtttcagttttgtcttctttataatggcattagaacagttgcccgcattttagggctgtagataagagagtccttttaaaatgtttcacacaacagtgagtgctgtgggttagttattgttagagcagtagtgttaataggctgaataaaatgggattgaatgctaatgtttccttccaggcacatttcagaaaagcccaagccttagccaccctaggcaaggtggaggaggcactaagggagtttctctactgtgtatcccttgatggaaagaacaagagagcaagatgtgaagcccaaagagtgagttgaaatgacatcaggtccagctgcctactggaccctcccctctctgtcttatctaggaaggggagtgagggtgctgtcctccttggcatttggggtcctgagtgggtggttccctgggttaaggggacaaaagggagatgggagtgttaattgattgcccagaaacaccgtccttctggtgtgtacgatcagtttgggcagtttctacatttttgtaggagcctgtgaggaatgttcttgcttctttgactcagggtctggattgtcagtgggagaaaaaccaaaatcaagtacattaatatggggattgaggctcactgaggacattctggctgttgatgagagatccagggcatggggctacctgctgttacataacttttctttggctgaatcacagttttcaccagccacacatgacagccagcccctgggaagggacgttggtggtccccacctcccctatcaccatacacagaactccaaccttcagctcctttgctagaaataaaacacactgcctcacaaatgctagtcagagaccattacaatataatgcaagcagtcgttccaactcttgggtcccagcagaatgtggtagttataaaagaaaaatggtgtgaaatactgagagcattagtgaaggctcagccatcttcaattcatggactttgttgcttattgttctacagtttactctgctggtgtctgggtaatcggcctgtaagttggattctgacagttggcggttgtctctgctctccttgtgccccacccactattcaccgcggagccttacggtttctgtcccagtgtggtttggcagagcagtggataaagaaagtgagcaagagacagaactggtttctgaaggctctagaaaggaatagttagcaaaatcaatgaaataagggaactggccctggattttctgtctcacaaaagatctcctttctgggaagttgctttgaattggtttgagtatgtgaaaaaggtgtgcttgagaggagcacggttcggggagaattgcttcaagctgtggacccttctccaaatcttaagtgtagtccatgatgtaatgataataataatagctaacattcgttgagaatttcttctgcattatacactgtgctaggcattttatgtggagtatattatttaaatcccactacattcctgaggctaggtttggttagttatcctcaggttacaggtgagacagatgaagctggggcttgctgactttcccaaggtcatgcagctggtgattggtgggaaagtattcaaacccaagtctatctgcttccaaagcctggcctcttagctgctctgccatcctgcttcccatgaggacatggccacagccttagcactcactggtgaagctggatcaatagtagcaatggaactttccagttccaggatgaacaaaggcagttagaagaaacttatctttggggacggagcgtgcaaaggccagcagaggcaggtctcagacccaaggaggaatggtttcttgactcttgtttgtccatttcccagctagcctgagatgtttttggtgtcatcagttgggctgacctgtctctccagtctgcttttatagagaaactgttgtcatttccacagctgcctaatggttggaggcaaggcattgtgtgaagctctggagacccaaagaggcataagtcacagttttagtcttcaaggaacttaacaatcttgcatttgttaacataaatgccagatgatgcaagcgagtgtatgcccgtgatgagtgttacagagttctgaagtgagggcgagaatttagaggcgaatttccactgggtgtgatgaggccatggcggcgattcagaacatcaagagtcctcagttgtgtttatttactagatcattccagtttcagggctaaagatttgacagagatgatgcaggttcagttgacatttataagctgccttcgaactcacaggctgtgtttctttttaatgtttgtttttactgcagattctttttccctcttcttgacctatttgggcctttctaaggctgaggctgaagtggaattgactttcattcatgtggaatgatcattctcactgagaattgaccccaacttttgttttccaatgccattgagaaggcctagagagagatctcaagtagtaaaatgaagaagggaactgctgttattatttctgctttgtttcctttgatttctcccttggccttcttttccttcccaccaccctctgccctttcatccttgcaccttgtgatgctgtgtggctgccactgaagagtattatgctctttttgggagaattccaaggatactgcctcctcagaactggcttggtcctgttgagtcacgcattagggcttcagaggaccaaccttggctcctgtggaggagggacctctgaaagctggcatttatggccccgggtgctgtgagtacctccccatttaactcctgtgccaactcataactggaaagtgggtttctcagagctgaaaggaaacataaggatcaatctgaggactttgggcctgaatgctaggcctctccctgggccctggggtggataagtgtcttaattcaattccatccagtgtgatgagcatttattgggtatctgttatgtgccctctagaagctggccgtctggcaggagagaaaggcttacatctgtgacacatttctaggataacataacgtggtgttgttcaagatgctatattatggtgcactctctactactgtgtagaacaggactggaatagtgagggaaggtagcacttgagctgagctttgaaggctgagtggggtttggcttcatggcaagtgctggcatctgaaggaacatcatgaagagattgctgggggccagagaataaatcaaactggagtttggtgttctgtcaaattttgttgatcaattaataccctaactatgtaccctcagcacgggactggagcttcctttagtggatctccaaacactgcaggagctgctgggtggtaagcactggagcaggttttagaagcaaagtcacctgctctccttgtgttacatgtttcagtatatggaaacacacacacacacacacacacacacacacacacacacacacacacacacaatccttgctagtacaggggaaacttggggcaagaatgtggacagtgaatggtgcaagctacattagaacgcacgtctaccctcccagcttatccaattgcaagggaaaccagcaagagactggaacctccttgcgcctagtacttaaacttaacctaacatcctctgggaggcaaaggccagcataggggaggcgaggttgggagaagagggaggaagctggagttctgtttttcctaacagttaactgctcaggttcccagctttgaagggattaaagatccaggggtgatggtggggagaggaggaagcaaaatgggtagtggagaaaagaaacagtgaggatcctagaagacatttgtagacttctacccactgaggtattatgaacttcaaattccccaagtgaggtttctctcctgactttacctctctgtctctttcctcctagatgagttttaaaatcccactgcagatatttctgcggagtgttagcactagcatggtggctcttaaccttggctaggcaacagaggcatctgtagtgccttctcaaaatccagattcctgggccacactccagacctgggggagatgggagtacaaagtagagacctagatttttcataagttccccagttgattctgatgcccgctgaagcgaggacccctgccctggtgtggtgtgttagggacactggtccaaggcttcctccctggagttctgccctgcaagctggctccctccccccttcaccctcctccccttcacctgggcacctgtagaaacttaagtagtgaagtcttctgttttatgtcacagcttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggtaaaactcaactcacccagctcgctcgtgacgcttcgtttggctgttttgtgggcaaacgtggggagtgagccctccctctcctattttggttcctgagaaagaagaaattgagtcactagtggttctgttctttgcaaagaacctcttaaagatgcaactgtgaatttcaggcatggtcccagagtttattcattacattgaaaaaaaattatgaaacagggtctctttctatcacccaggctggagggcagtgatatgatcatggctcactgcagcctcagactcctggtctcaagagatcctcccacctcagcctcccgagtagctgggactataggcacgtgccaccatgcctggctaagttttttttttttttttttttttttttttgtagagacggggtttcaccatttttgcctaggctggtctcgaactcctggcctcaagtgatcctcccaccttggccttccaaagtgctaggatacatttttttccagttcttggttagatccagccgagagagattttacagagctagaaaggaattggctcactgcccctgggccataccatttgggtgggtttataggctttggggatgagtctgggaagagggcctaacaatccctcctttcgagcttttgtttgttcaagctgctggcctttgagtgccagcacttatcctgtgcaaagacaactctgatcctcaaatggatgtaatttcatattcctgcactatgccttatacataagtaagcttccaatacgtatttgtaacagagaagaggaaagagatgttggaaagaaagttgagttgaaggacctgggaggaagacaggtatttgtacctttctttgaaaaccaggaaacagaacacaagagagatgggttccaggccctggctttcccggcagagggtaagtggtcagaagttgaggatcagaagcgcagactccaaggcagagtttagcactgaatgcctgggcatctttagggggcagttttccctccattcatgcccggtgttcttctcctgtgtgtaagccctgggctctcataaaaggactgaaatgcaggtgcgcccaacttttcttaaaaaatggcagaacttagaggatctcctgaaatcacagaacccccagtgatttcaataattaagatcactattaaatgattgagaatgctaatactgaacccaaatgcctggagtgacttctaattgcagctccatctgaaaagaagaaaaacagcaaccttggctttccaatgtcaaccagctggggaacaaggattggatttccacccaaactttgctttgcaaagcagtatactcctgagtggccaatgccttgggttcatggaaagtcaaggttgtagtattgctgtagtgctggagaaaaccccaactcccaagttagacacagagaaaacccacattatttttgtcctcacctcattgttttctcccagctatatgctcccctttttcacctgtctgccagtttttttttggtagggttagagggaaacaacacgatgagtatcttgacctatggactatgggtttagattagagaggggttctccatgtaaatctgcataaacatgttgttattgcacttatttctaaatcctttttcaaatatccatctcctgggaaaatattcttgaaaaggctagagacattgttgattttttttgccaggtgattttgtctttttttttttttttaatgcttttcaccccaaatctagtaaaaggaatagtttgtaccttgttcatttgaccagtgtaacatacagacctggagcatgaggtaacttggcaggcctgtgaacagacctgtgccaaagccctaccaaaagtccttttggagctggagtttggggatcgcagacggccgtgaatggcagtgagggcgagaggaactattgagtgacaggatctgccgtcactgcctgccttggttttgctaaagtggttactggggaaggattttataggaaggggaactggtgcctatccctggcatttcccctttttacacctgcccaaggaggctctcctcctacataccttcctgtccttgcctaaggaagttccctaactccacccaagctgggaatgccttggttgcagatactgtgcagaaaagaagtaggaaataatgccttatgacggcccccaagttgagctctgtgtccactatgagttcggggtggggatcaggactctatagtttccctttgttcctctgggtaggaatatgagaggacaatattagtcctaagaagattctgatatgtggccctttcttcatccaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaaggtactggctctacccagagagaaggtagcttggaggagatccccgggctcaccaatatatacaagttacttacctctgtctgggggctccttaggctctgggtgtggggcccagctctggcatttactagctgtgtgacctcagagattgctatgaggcttctgtgagatcatgtacagtgcctagcacactgtaaaaagtgttcaatactaattattaatataatggaaagccaaggcatcaggtcaagcacagtatcaactaatgacatcccatacccatggggatgccacttccttctaggtcagcctcttgctacccccatccccattctaggaatgcaggatgaggaaagtgaggtcaggcctcaccctgctcattcccagttgtgttcccataggtaggcatgtgagaagcagcagctgtggcttgctatctttccacgagaggttggcagtgccaagattcagttttagctttgaaggcctggctcagtccattgagttgctgtagcttctgctgttgacagaggtgcatgttgcatttgaatgaagtccccagggctcctggacattgtttgacttgcatttctctttctgttgggcctgctggaaacctctgagagcctacttctgagtgtcccattctcaacggctcaggtgtccactaaatcaactctctgggaggtggtggtgagagtggcaaactgaaaaacgcattggattattttgcctcagaagtactatctatgaaaccggggtggctccagcgctgacttcttgctttctaaatcgcagatcctcccactgatcagggggacaaacctgctctcagtttaccacttgcatctttcgacgcatctgaccttgaatgcgctctatgtatgaggtacgtcctgtgtactatcatttacttcctgatgtttcttcatctctggtgtctggacctttctgctagtgacctactgctgggttggttagcatgtaaaaagcatagctctaacggaatggaaatcacaacgttgattgtcacatgggtcagcttgtgtccccttcccagagactgcattccctgcattcctggctcctgacttggaaaaacctggagagtgggaagggaacagtctattcacaggtcacaaactgatggcccactgggctgaatatgtctgaatatgtcttttttttttatgtcttttttttggagacagagtcttgctctgttgcccaggctggagtgcagtggtgcgatttcagctcactgcaacctctgtctccccagttcaagcgattcacgtgcctcagcctcttaagtagctgggattacaggcctgtgccaccacgcttggctaagttttgtatttttagtagagacagggtttcacaatgttacccaggctggtctcaaactcctgagctcaagtgatctgcctgcctgggcctcccaaagtcctgggattacaggccactgcacccagtctgaatatgtcttttgtttggccctcatggggtttgtttttcttaaacgtgaatgtcttgagacaggacatgtactctccatttgaccacgcccccgccacccacctgccttattccaacctgtgtgtcacaattgcattacattcttagcccctagagataatttaaattttggatcccagcactaatctcagttacatgggcaagagctcaaagttcaaggactactgtcaccaccacagactattcttgggaagccaagtggtgggcctgactagcttttgttttgtgttgtgccatgaatattagtggtgggcctgagatacttagccaagtatctccccaccaaacagtgccacatcatctctactttctcagatctctggagaggcaaattattcacatgctcccccaccccaaaagaaagaggctatgattatggtgtgtgtaaccatacacaattttttaaaattgcttacatgtctttgatttcacagctgtgacttactggcttagaggagaggctccctgctctgtcatttactggctgttgacctggatggagcaagtgacattctctgctactgttttcttgtcagtaaaatagagaacagtgtacctactccatagggttgtcatgattaattgagaaaaatctgtttaacacctggaatagtgcctggcatataatagatactcagtaaatgttaactatttttttttccttgtagaccagaggtccagaaggaaactttgggtctatggacctctgaggatgttctatatatggattctaatagatgtattaatgtctcgaagttgtatgttaaagtatgtgggttttccaggacaaggtccacatcctttagcagattcacaaatgtgtctgttttccaaaagagcattaaaaggaggctgagatatttgcacaaaaattaagacggttggcaggctgctgttcgttgtgctggcgggtcctgcggggagggctgtggagctccagatggactaaagaacaaaccagcaatcccgagagggcccacagtccctctgaaggaagcgggttgcttctgcaggacccaggagacaccccaaatactctgggaggcaaatagcctcggtcgagttctcaagtccctctcactctcctcctggaaacagacttggagctgttggggagggcacggtggaagtgagactggcccttcagtttgcatgggagctgggtgaggcctgtgactgctgtatttccccaacttccctggtaacctgcatgactcagcaaaggcagccataatcctcctaggtacacaactccagtgacctgggaatctcacccccatcccccacagcagctgcagcaagacctgcccaaggagagtctgagctcagacatacctagccctgcccccacccaatggtccttccctaccaaccctggtagtggaagacaaagggcatataatcttgggagttctaaggccctgcccaccgctggtccctctccacactaccacagctgttgttttctggaaagcaccacctcctggcaggagaccaaccagcacaaaaatagagcattaaaccaccaaagctaagaagcctcatggagtccattgcacccaccaccacctccaccagaacaggcactggtatctatctactgagagacccatagatggctcacatcacaggactctgcagacaacccccagtaccagcctggagccgggtagactgtatgggtggctagacccagaagagagacaacaatcactgcagttcagctcacaggaagccacacccataggaaaagggggagagtactacatcaagggaacaccccgtggggcaaaagaatctgaacaacagcctttagccctagaccttccctctgacagagcctacccaaatgagaaggaaccagaaaaccaaccgtggtaatatgacaaaacaaggttattctaacacccccccccaaaaaccacactagttcaccagcaatggatccaaaccaagaagaaatccttgatttacctgaataagaattgaagaggttagttattaagctaatcagggggataccagagaaaggcaaagcccaatgcaaggaaatccaaaaactggcacaagaagtgaagggagaaatattcatggaaataggtagcttaaagaaaaaacaataaaaaattcaggaaactttggacactcttttaaaaatgcaaaatgccctggaaagtctcagcaatagaattgaacaagtagaagaaagaaattcagagcttgaagacaaggtcttcaaattaacccaatccaacaaagacaaagaaaaaaagaataagaaaatatgaacaaagcctccaagaagtctgggattatgttaaaccaccaaacctaataataatcggtgtacctgtggaagaagaaaattctaaaagtctggaaaatgtatttgggggaataatcgaggaaaacttccccggccttgtgagagacctagatagccaaacacaagaagcacaaagaacacctgggaaattcatcacaagcagatcctcacctaggcacattgtcatcagattatccaaagttaagatgaaggaaagagtcttaagaactgagacagagcaccagctaacctataaaggaaaacctatcagattaaaagcatatttctcagcagaaaccctaaaagctagaagggactggggacctatcttcagcctcctcaagcaaaacaattaccagccaagaattttgtatccagtgaaactaagcatcacttatgaaggaaagatagacattttcagacaaacaaatgctgagagaatttgccattagcaagctaccactacaaaaactgctaaaaggagctctaaatcttgaaacaaatcctggaaacacaacaaaacagaacctctttaaggcataaatcacataggacctataaaacaaaaatacaagttaaaaagcaaaaacaaaaaccaaagtacacacgcaacaaagagcacaatgaatgctacggtacggtacaccacatttcaatactaacaatgtaaatggcctaaatgccccacttaaaagatacagaaccgcagaatggataagaactcaccaaccatctgctgccttcaggacactcacctaacacataaagactcacataaacttgaagtaaaggggtgaaaaaaaggcgtttcatgcaaatggacacccaaaatgagcaggggtagctatttttatatcagacaaaacaaatttttttttttttgagacagagtctccctctgtcacccaggctggagcgcaatggtgtgatctcagctcactgcaacattcgccaccgggttcaagcgattctcctgcctcagcctcctgagtagctgagattacaggcacgtgccaccatgcccggctaatttttgtatttttagtagagactgggttt[132 bp omitted]aagagacaaagagggacagtatataatggtaaaaggccttgtccaacaggaaaatatcacaatcctaaacatatatgcacctaacactggaagtcccaaatttataaaacaattacgaatagacctaagaaatgagatagacagcaacacaataatagtgagggacttcagtactccactgacagcactagacaggtcatcaagacagaaagtcaacaaagaaacaatggatttaaattatgccttggaacaaatggacttaacagatacatacagaacattttatccaacaactgcagaatacacattctattcaacagtgcatgaaactttctccaagatagaccatatgatagaccataaaatgagcctcactaaatttaagagaactgaaattatatcaagtactctctgagaccacagtggaataaaactggaaatcaactgtaaaaggaaccttcaaaaccatgcaaataacatggaaattgaacaacctgctcctgaatgagcgttgtgtcaaaaacaagatcaagatggaaattaaaaaattcttcaaactgaatgacaataatgacacaacctatcaaaacctctgggatacagcaaaggcagtgctaagaggatagttcatatccctgagcacctacatcaaaaagtctgaaagagtacaaacagacaatctaaggtcacacctcaaggaactagagaaacaagaacaaaccaaactcaaacccagcagaataaaggaaataaccaagatcagagcagaactaaattaaattgaaacaacaacaacaatacaaaagataaatgaaacaaaaaatgttctttgaaaagataagtaaaattgatagaccattagcaagatttatcaagggaagaagagagaaaattcaaaaaacctcactaagaaataaaacaggagataccacaactgacaccactgaaatacaaaagattagtcaaggctactatgaacacctttatgcacttaaactagaaaacctagaagagatggatatattcctagaaaaatacaatcctcctagcttaaatcaggaaggatgagataccatgaacagaccaataacaagcagcaagattgaaatgataacttaaaaattgctaacaacaacaaaaagaagtccaggaccagacagattaacagcagaattctaccagacattcaaagaagaattggtgccaatcattttgacactattccacaagataaagagggaaccctccctaattcattctatgaagccagcatcaccctaataacaaaaccaggaaaggacaaccaaaaaaagaaaaccacattaaggtatgtcccttgtatgctgattttgctgagagtgttaatcataaagcgatgctggattttgtttaatgatttttctgcatctattgagatgatcatgtgatttttgttttgatttcttttcagtattatgttggttgtgggtttgtcataatactgaacggggaaaagttgaaagcattccctctgagaactggaacaagacaaggatgcccactcttaccactccttttcaacacagtactggatgtcctagccagaacaatcagacaagagaaagaaataaagggcatccaaatcagtaaagaggaactcagattgtcactgtttgctgatgatatgatcgtttaccttgaaaaccctaaggactcctctagaaagctcctagaactgacaaaagaattcagtaaggtttctggatacaagattaatgtacacaaatcaggagctcttctatacaccaacagtgaccaagcagagagtcaaatcaagatccccttttacaatagctgcaaaaaaataaaatatttaggaatatatctaaccaaggagtcaaaagacctctacaagaaaactacaaaacacaggccaggtgcggtggctcatgcctgtaatcccagcactttgggaggccaaggcaggcagatcacgaggtcaggagatccagaccatcctggctaccacaaagaaatcctgtctctactaaaaatacaaaaaattagccgggcgtggtggcatgcacctgtagtcccagctactcgggaggctgaggcaggagaatggtgtgaacccaggaggcggagcttgcagtgagcagagatcacaccactgcgctccagcctgggcgacagagctagactccatctcaaaaaaaaaaaaaaaaagcaaagaaaagaaaactacaaaacactgctgaaagaaattggagacaacacaaacaaatggaagcacatcccatgctcatggatgggtagaatcaatactgtgaaaacgaccatactgccaaaagcaatctacaaattcagtgcaatccccatcattcttcatagaattagaaaaaaaacaattctaaaattcatatggacccaaaaaagagcctgcatagccaaagcaagactaagcaaaaagaacaaatctggaggcatcaaactatctgatttcaaactatactataaggccatagtcaccaaaacagcatggtactcgtataaaaataggcacatagaccaatggaacaaaatagagaacccagaaataaacccaaatacttacagccaactgatcttcaacaaagcaaacaaaaacacaaagtggggaaaggacacccttttcaacaaatggtgctgggataattggctagccacatgtaggagaatgaaactgaatcctcatctctttgtacaaaaatcaactcaagatggattaaggacttaagcctaagacctgaaactataaaaactctagaagataacattggaaaaacccttctagacattggcttaggcaaggatttcatgaccgagaaccgaaaagcaaatgcaataaaaacaaagataaatagctgggacagctgggacctaactaaactaaagggcttttgcatggcaaaaggaacagtcagcagagtaaacagacagcccacagagtgggagaaaatcttcactatctgtacatctgacaaaggactaatatccagaatctacaacaaacttaaacaaatcagtaagaaaaaaacaatcccatcaaaatatgggctaaggacatgaatagataattctcaaaagaagatacacaaatggccaacaaacataaagaaatgctcagcatcactaatgatcaggaaaatgcaaatcaaaaccacattgagataccaccttactcctgtaagaatggccataataaaaaactcaaaaaacagtagatgctggcatggatgtggtgaacagggaacacttctacactgctggtgggaatgtaaactagtacaaccactgtggaaaactgtggagattgcttaaagaactaaaagtagaactgccatttgatccagcaatcccactgggtatctacccagaggaaaagaagccattattcaagaaagatacttgcacatgcatgtttatggcaacacattcacaattgcaaaatcgtggaaccaacccaaatgcccatcaacgagtggataaagaaactctggtatatatatacaattgaatactatgcagccataaaaaggaataagttaacagcatttgcagtgacctggatgagattggagactattttaagtgatgtaactcaggaatggaaaactaaacattgtatgttctcactgatatgtgggagctaagctataaggatgcaaaggcataagaatgatacaatggacttggggacttggggggaaaagtgggaagggggtgaagaataaaagactacaaatacggtgcagtgtataatgctcgggtgatggtgcaccaaaatctcagaaatcaccactaaagaacctactcatgtaaccaaatacctcctgtaccccaataacttacggaaaaataaaataaattaaaaacagaaattaagaagattgacccaagagaaaatataacaaaagtctttttatttatttcatttttaaaaataaagttaaattcattttgtttttgagacagagtctcactttgtcacccgggctggagtgcagtggtgtgatttcatctcactgcatcctctgcctcccagttcaggcaattcagcctcctgcctggcaaatttttgtatttttagtagagatgaggcttcaccatgttggtcaggctggtcttgaactcctaacctcaggtgatccacccgccttggccttccaaggtgctgggattacaggcgtgagccactatgcctggccctaaaaaagtattttcatacactacatggtgggatccagcgagcagaaactgctcagatatttcctcgccctttatgagcacatatgcttctcatatcgatcatgtgcatttgtattctgaatgatcgttgttggatgactgaaaacgagtaacacagccgttacctgaaatgtggaccttctttctcttaaaaaaaattttaggtgccagattttctcataagctttggcagacctgataacaaacagctcagcaggtggaatgttgaagcactcaaagcaagcctcccatgctgtcaggagttggtgtgggtggagtgggctagggtgggaggggctaaatgagcaggttcctttcactacttccctcaccccctcatgatagaatggcaggtgggttctggcaaagccaaggtagaagatagagaaatcctgcttccaggcagagcaatgggctcctgcaggtaacaccgttgtggctctaagcccatgatgtgcgctgtggagtagacttgacttagcctgctcagagaccaggtctttgttgtgcgtatccttcttaacactccctccaacatccaggggacaagaaatcaaacatacagactcatcctgtttgtgttttctctgaaaactaagaatcctgaggtgtaagttcttttgttcctctgctttctccctttcatcttgtttgtccttgaactcaacagggggctttggaggaggtctcaaaatttggtccaagaaataaacaccaagaggataagacccccttccagttggctcactcgaaatttaaaagccatcatttcccttatcctgcccctccgttctaagtgagacttcaaaacaaaacaaaacaaaaccctctgtgcctggagtagccattgcatacactgctaagttatagctggcctctcactgcttgatggtgataagaaacctactaaatctagaaagaactttggatcttgaggttctgaaaactgcagccattggtcagaagcatgtagttccctttccaacagggtttgtctataagttagacattggatgttgacagaggctatttcaaacacatgcttcagcttgaattatgatagccttgacaaagcttttgattccacctctccagtgtttttcttctctttcttgttgttaggaatatgattggttctcttattaccctcatgtgtccttgggggagagtgtctgagagtaaagaaagtgtctgaaacaatctgtggaggtcatgaaattagacatttgtactacttgtgcaagattttagtatgaaatccagtttcatggtgctgcattggtagaaaaacaagttagagtatgaatttgtatacacggattctagagagaaaattaggagaagcaggttgtaagttccacagggaaaagggtgaaaagagtgaatggaacaataatcggaggtgtgtaagtgaggaccattccaatctccaggtctcccttgctgaactgggggagctctgttgagagaagttaccccctaacttcaacccttaagaactctgctcctcaatccttagtggttgcaaattctcctttgatatttgcctcgtgtggttaccttagccattgggggccacctctggggctgctatggagcagaacttttggggtgacaaagacattttgagatatgcagtaagaatgtttgatatttgaaccagttatctaatggcccagtgacctctttgtcaattctaacaagaagcttcatatttaacctagttttagctactcaagtagcttggtgttaaggatcttgtcagttcactctcattctctctctctctctctctctctctctctctctctctctctctctctctctctctctctctctcactgtcactctctcttcctccctccctctctctccctatttctccctctccttctcccctccctcctctcctcctcctttcctctttgctctcatttgatagcaaaagaaaacaatacaaggatgtaactggtgggaaaagatagctatttccagacaagccaaacattttatctgggctgacatcaaactgaaagcatttattattgctattgtttactccatcactgtaacaatgtaaaatgttttttgtgtgaaaatctggccctgctctgatttataaatacctcttggatgtgttttctgaaatcgttacctaaagtggtaaaaaaattctagtcaagttctctctgtctctctctttttcagaaggagggagagaggagagagggagggaggaaaatgtgcatatgagtgtgtgcatctacatgtagatggatgatgtctatttggatgcagaaatacatgcacacatttgttgccgcatcatagagtgaagaagaaagatgggcttgagagtcagatctgacctgacatcccaaagccctgctacttaccagctagctgtgtgatcttaggcaagttattttaacctgtctgggtttaaattttctcaatagtataatgaagctaatcataattaccacctcttaatatacaaagttaagtattgacacaccaagaaatacagccagaaaaatatattccatctgttccagtcactttggctgtgcagagaagcagagtagccctaaatatagaaatgaattgagtattgaaaagtgtaatgtattctaagcatctgaaccctgaactatttcaaaggaataattatgcagcatctgtggccgcatttgtgtttgctaccactcagtcaggggcattttaatcacagcttttgctaagagattgctgtgtccttttgtgtgtgttttattcatctgctcactaaatgtcagtatttattgcaattaattagccagctatatctttgttattttagatagattacattaggttacattcttaaatgaacaataggcccaattgcaaaattctcaggaaaaatggttttgcatattagttgtagatacagattcatcaatcatcttcatcattagtaccatcaaataatataaggcattcagattcacaggactaagttaccaaggaaatgagatattttggtttggctgctctgataattagatcacagcagtggttccaaatcacacttttgaaaaacattttaaattgtgaaatacacacagtggaaaagtgcataaaatataaatatgttctcttaacaaaatattgtagagaagatacttatgtaacccctctcagttcaagaagtaaaatattgccaggacccaagaagctacccatatgcctcttcccaatcaggactatcctccctaccccaaccactatcttgacttttatcttgtttctctttttagctttactacccgaatatgtgtatctaggcgatgcaatctagttttgcctatgtaaaagctttatataaactgaattatccagaatttattatttcaatctggcttcttttactcagtattaggatttatccatgttattgcatataggtaaagtttgttcactttcattattgtataatatcccattatatgaatccaccacagtctgtttatcagttctcttatggatggatgtttggattgtatctagttaggggatatcatggacaacattgctataaacattgtttacatctgctggtgcttataagtgtttgttcattttctgttcgcttccttctctttttcttactgacttctagggtgtctatgtatgctctagatacaagttctttgctagtcgtatgtgttgcagataccttctcctactctggcttgcctttttgccctcttaatgacattttttgatgaacttaaaagcgcttcttcttgtttttttattttttttttattttgagatggagtctcactctgttgcccaggctggagtgcagtggtgcaatctcggctcactgcaacctccacctcctgggttcaagcgattctcctgtctcagcctccccagtagctgggattacaggcatgcaccaccacagtctgctaatttttatgggattttgccatgttggccaggctggtcttgagctcctcaccccagatgatccacccgcctcagcctcagagtgctggggttacaggtgtgagccactgcacccagccaaaagctcttcattttaatacagtcaaaattatcaatcttttcatttatagacagggtcagaattcattttttttaccttcaggtcataaagatattctcctattttatctttattttcttttatttgactaattaatttatttgagacatggggtgtcaaactcctggtctcaagcaatcctcttgcctcagcacccccgcctcaagtagctgggattagaggtgccagccactgtgcctggctatttcatcttatgaacgttttattgttctgcttttcacatttatttttacagcccacatggaattgatttttgcgaatgatatgagagatgatccaatttcatttccccctatagatagccaactctcctaataccatttattgagaatgctatttatgtattgaaaatctttcccccatctgctttgaagtggcacatttgtcataaatcaagaatccacgtctggatctgtttctgggctttctgttctgttccccgagtctatttgtccttgtgctagtcatatactgttttaatcactgcagctttatatgttctgtaatctggtagagtgagtcctcccacatcgttgctcttcagatgtatcttggctcttggccctttgcttttccttataaagtttagaaatcaacttgtcaagttctacaaaaataaacaaatgaaataacccattgaggttttttattgggacttagttgtttaatttctttcaatgaggtgtttgtagctttttccaatagaggtctcctacaactgttgttagatttcttcctggacacttgatttttaaaaggagttgcaaatgttatctttaagatgatgacatttctaatgtctattgctggtatatagaactataattgtgtgtgcacgtgtgtgtgtatttatctagtaactttgttaattccattcttattctaataatcatttgtagattcttttagatttttctaagttcaccatcatatcatttgtgaataatgacagatttgtttttttcctctccagttctcattttttttcttgccttagtgcactgagacctccatagtaaatagtttttcttttttaaataactttgctttttggccaatttgataactaaaatttattagttttaattaatttgttaaacaaattaactactttttaaacagaatcataaaattcaaaaagtaccaaaaagttgaatacatgaaaagtctctctcctcctccagacctccattggcttgttaaaaatatcccatttctgctggtctccttgacctgctgaatctggaactttagccagtggagcttcacaatgtatgggtttttttgctccacacgtaactgatatttgaagaccaatacagtaagtttgcctatgcagagattaatgggattgtgtaacacagtgatcctcaatcttggctgtacattaaaaccactgggaggcttaaaaaaaatttctgatgcctgtcctgtacactgggcctactgatctgaatctctgtaggtgctgtagtgggcatctagagttttcataggctccccaggtgactgggggaggcaggaaggagggcttacaaaggggcatgaggaaacatttgggagggatgggtatgtttcctatcttgattgtggcgatggtttcataagtgtgtacatatgtcagaacttatcaaattgtacactttacgtctgttccatttattttatgtcaattttgcatcagtaaagctgtttaaagataaagctgttcaggtgattctgatgcacagcaatggttgagaattattgttgtaatagaaaaggcacatgactgaagtggaagttggatagactttcatctgtcaacagttggctgtgcgcacttagacaagtaacttcaacccctgtggacctcaggttcattctagttagtgggttcagtttcttctcaagtacttttcagctggcatgttgcttcttctactcagtctggcagtgctggccaggctgctggtgcacctcctggccacacgagggagccgtgcagctggcagcctctgactctccactgaacactcttgtgaggtgaaaataggctggtcaggcaggggtctttcccttcttcctgtgctgctcctcttggtgagtgcaagccccactcctcaacggtcatcttcagctaccctcactcactgatctcgctgcaggtgagcctttttttaagcaaagcaaatccattaatttctgaaggtacagaacaaatttataaaaggattcccacattgctttgaaaatatcctgttctccccaagcaattaaaatagtaccaaattgaagtatatgtatgtatatatatgtatgtacacatgtaaatgtatgtatatatgtgtgtatatgcatcaatatagatccatatctagtctatatcagtaagcacactaacaatactattctcctgcccctatgaaaattatctatataaaaggcagttatgtttgttagaggtacaattttgatatccttcaggcattaacattgcttagacgaaaagaggaatcaaggttagcaaacggtttttttccatggtaatatgatgtaaagtgcttaaatgggtaaatgtgtaagagagagaatgtgtgtgcgtgtgtgtgtgtttgtgtgtgtgtgtttacatatactcaggtgaacaggttggctaaatattttcggaatggaatttatccagacactctgtgcattaatctctatttttcttggaccagacagggcaaaaaatctgaattccccagaagagatagactagaattgatgttacaaaatgatctagctatgccctaaactttaataaatgtattttaatccagctcaaaaatgaaaggcaaatgtttatctgaagtataacaatagcgactttttaaaaagaactcctcccccaccctaaaatattctaaataatgctttaaaaacttagctttgagtcactcttttatttttggtcttattgcagttttcttccattttgattcctaaatttcagattattctatgagccagtcacaacaccttgcgggcatactttttgcttaaaatgcctagaaagatgcctagatcacaacgcaaagtgtccattgtgcaaagacggtctttcacaggtaaatcaatatttctttcttgtttggtttaaatcagtatttctttcttgttttgtttagtttatttggaattgggcactaagacagtgttcaactggacccccagccacggcactgtggtagggcacattactccctcaaaccatctatttctcctgtcttctttttttttttttttttttttgactgagtctccactctcccacccaggctggagtgcagtggcgtgatcgcgggtcactgcaacctccgcctcctgggttccagcagttctcctgcctcagcctcccaagtagctgggattacaggcgcatgccaccacgctcggctaatttttgttttgttttgttttgttttgttttgttttgttgagacggagtctcgctctgtcgcccaggctggagggcagtgacgtgatctccactcactgcaagctccgcctcccgggttcatgccattctcctgcctca[222 bp omitted]tggtcaggctggtctcgaactcctgacctcaggtgatccacccacctcagcctcccaaagtgctgggattacaggcatgagccaccacgcccagcctatttctcctgtcttatagccactgtccccctctccataaagtccttcaggaaaatgaggcaacatgcagctttttatgcagtgtaagtagggaaattaatttgtgttggaaacgaaagtattaaatagatgataaacttggatcctggttctaatgtcatcgtggcacctgatacactgtaatcttgagtaaatcttttgtcccctctaggattggactaggtaagccctgatgttcccttatcatcagtgtttattctgtggcttgaagataacagctccaaaggccccagaagaacctcacagaacttcagtgtgatccttgtccaacccatcaggagccactgtacctggaagccctagagcttttgcagaccgcagccctctaggacttccaggttctctaaaactaatcacacaaactcccacctttgtttttcaagtgaacctgaaggaatttcctacagataaagaagacctgagaatctatcttgttttccctccctcagggacttatctgccacattttacaatcggtgttaatgttccttgacccctgtcattcctgaggagaggttggagatgcaaggctatctctaggtgactacaggtcaagagaagtcacatgttgagctttaccatcaccccagtatttaaattaagggaatggagtgaaatcatcatcactggtagccctgagggtatgcgttgggattgggaggagggtcaatgtcatacctttccctggataaagttgtaggatttgcaggcctgattgtaggtgagaagtccttgatccttatactgaaataatacatctgtgttgttgtagcactggaaaattcagattaagtggaaagaagaaaaatctacccatatgctcagtacctagagaaaaccactgttagttaacattttagtatgtgccttttctggctttttgttttagtatcagcagaggagtcacctactttttagactgactacctcctcagtcaatgcttatcccccacaactgggactgggaaatgcagttgattttcccatagccaggcaatggcagtgacagtggcagataaggcatcctggagacagatgctatagagttcaggacttggggtctagaagatattctcatctatctctgtttattcacatagggtcacacttgcaccattttacatagaattaaatattccaatcattttcactgcagaatagagacacagcccatactgagaaaggaacaaaattgtttgaagccaacagttttatactcaggcgctccccctgctgggactgtaggggtagtttccatagcaagcaattctctgcagatgttttaacatcagttgtttgattcacaccgttaaatacccactacctaaacatccctgggtatgcatcggacaggggtgtttgggaggagagtaacagtgacaattgagcctgagtccagttcttgaaatcatgacttttaatctcagtgatacctagatggtatattagaaaggcaaatagacaaatcaatatttagctgtttgtgtttttttaaactaaaattaaaagagaaaaaataggtatatttggcaatatccagaagccaagcattgggttaggctgggagtgggacagggcaggaaaggttcagtgattgaaaattgctttttagttccctgaaacttttggccactaactttgagcatatcccagatggagacaatttctgtgagcttgtaaatacaatcatcagaaaatggaaagggaagaattccccccaccctactttttggacaagaacatgatcttgatttcagtgtttcagaaaaactgtgagagttttaaaacttcaatgcaggttttacccccttgttaaaaatttttttctaattataaagataatcaattgcatgtgtgtttttttaaatgaaactaacatccagaaaatacatatattatgatggtaacagctgctaatttgtgggtccagattactccaatatgtgggtcatttgacttgttcactgattacatcagaagtgttttgctgattgctacgtattacctaattgcatattgtctaattgcctccccccatgtagtgcttggcatcaagaaaatacagcaaaaatgtaataatggaggagctcatagctaaattccttccagaagaactgaaggaacgaaggaagctttatgaagaggaaatggaagaactttctaagtatgtatatgcatatttctgttttgtttcactcataccagctcaatgagagctgaatgtgcacattacttcccagcttccgacttagtgatgtcatgctagctgcttgaaattggctatggtgagagtatttacaccatggaaattggcaagtgctacaaaccagggtttccgctgcacccagagagccagttgttaaacataccagcataccactgaagaagcataagcgaaaccagtgatgagggtacgccctgcccccagtaacagggtattgttggcaagagtaaattggagtagcataaacaggggaacttaacgaaatgtccaaaagattgttttcagatacataaggagttgctatgaggttaagaactttggtgtcaaccagaaccgggcttaagacccagttctacctcaaagtgagtctacttcacgaccctaggcaggtcatttaacctttctgggccttagtttccttatctgtagcttgagaataatttaataacttgagttcttacctcatggacttctttttttgagattgagtctcactctgtcacccaagctggagtgcagtggtacgatcttggcttactgcaacctccgccttccgggttcaagcgattctcctgcctcagccacccgagtagctgagattacaggcatgcaccaccatgcccagcgaatttttgtattttttagtagagacagggcttcaccatgtttgccaggctggtcttgaactcctgaactcaagtgatcctcccacctgggcctcccaaggtgctgggattacaggcgtgagccaccatgcctggccacctcatggacttcttatgaaaatcaaatgagtttgtgcatagtaagcacttaattaatggtaataatactaatacttgtcaagcgctttctctgccgtgcacaggtaatgtgagaggtgaaggggaggggcagaggcgtcattgaggctctcagcactctgcctggctgtaagaacagctcccttagcagaaaaagcaggaggcaatcactaatttctgcctctcttgcttctgccctctcctccctccatccgcagtagaatcctaacagcattccagaggcaaggttcctgacagcaaaaatggttctggtttcatgcccactgtgtagagaacattcgtaaactctgccagtggcttgtttgaatgcactcctcacttagactaatgcttttctcagaaactagaaatcgttttttttttctcattaatttacattggaactactcgggggatctttatctttatttctgatctgtaaattagcattgagcctctctgagccctcatctcaaatctcatttaaggtcttattaacaaatactgagatgtattagggctttctatgtaaatgaatcctgaacttgatccttttgagatttgggcagttggtcttatatttcttgataggtttaggttcagatgttcctgtgttggatttactagacaaataagacaaggatcccagaagagctggctctgttttggttccccaacgggttgtgtgtgtgaatctctgggggtacttattgaaaggcagggccgggcatggtggctcatgcgtgtaatcctagtattttgggaggcagaggccggtggattgcttgaggtcaggagttcaagaccagcctgcccagcatggtgaaaccccatctctaataaaattacaaaaattagccaggcatggtggcatgcacctgtaatcccagctactcaggaggctgaggcaagagaattgcttgaacccgggaggcggaggttgcagtgagccaagattgcaccactgcactccagcctgggtgacagagtgagactccgcttaaaaaaaaaaaaaaaaagaaaaagaaagacccttgggtcccaattccagagctaatgcatcagtatctctggtaatgtggtgtccaagtcatcttgattgaagagcccctgttgattctgatgcaaagaagcatttgagcatcactgggctggattattcttgcctatctcttggtccttcctcctttcagctgtgcctcctttgcagactctttggggtccttgcaaatttgagatgccctagggaccttacagagaatttcccaccacccttctggagagctgagtccacttctatcatcagcaaccttccccatgcagcctgaaaaacacctgaaaagattgttttgagtggagagcatgaaagtaagaaaaaatatgaattatagctatcatccacaatattaagatactagagaacttcttcagccaaattaaaatgtgtagaatgccaattttaatttcttagaccttaggctaacctctgcatcagatcatgggactcagcccacactatcaattgcatttcaatatttttctattagccatcaaaacttgatgtatctttggcaagtgacactgtcaaaaaacaaacttggtgtctctgccttcccccaggggtatcacatgctaacatttgaccaatatttttgtgttctgtccgattgctttgagatccctgtcattttctctttctgacagccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtaagtgaggagccatgcgagcaaagggaggttgtgtaatgagggatttctgttttactttggggtactcccaggagacagggaggcctagctcatgaggtttagccaactgaagaatatgagcatttgtaaggatcattgtccctttggtggttagtttaccatgtgagaggctgtctatttaaagaaccctagaattaatatttggttaaacaggtggtatatgttataaaacttgtaagaatgtgggccttggagtcaaactgcctgctttcattatctagttgcagccttggagcaagtttgagtttgagcaagctatttaacctttctgtatcccagtttccttatttgtaaagtgggtacaataatagtacctacctcattgggtttgcttggaagattggtgagttaataatgtacataaaatgctgagcacagttcctggcttccttagtccattttgtgctactataacagaatgccacagactaataatttatgaacaatcaaaatttatttctcatggttctggaggctgggaagtcctaggtcaaggtgctggcatctggcaagggccttcttcctttatcataacatagtggaagggcatagcagaagggcaacagagagagagagaaagaagggggtcaaacttgcccttttatattaataacaaccctactctactttcaccatatcagcattaatgcattcatgagggtggaggcctaatcacctcttaaatgtcccacctcttaataatgttacaatagcaattaaatttcaaaatgggttgtagaggaggcaaacattcaaaccatagcactggcacagcacatagtatgtgctcaataaatggtagcagttacacgaatacattacgaattttttttcttcacacaggcactgcctgttgtgtaattgaagctgtaacccagggacaggaaaataggcagaagtcccttgagccacagcatggggctacagaaatggctgggtgccagcccagggaaacagaactcatcaaggatctagtctctcgactccattctcaataaacaggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggtaagggtggccagtgccaagaatcccaaagccaggctatccttgtaacttgatacacaaagatagttgtgaaaggatttctcagaacccttgagggccttgggatttcacaccaaattgctgcagcaacattgaatgctgctggattgctgtccagttgcactatggcagtgagggcgcctactgtcctggctctgcttagctgctgagttgcattcatgcataggaaatgttatcctagatcaaccctggggctcattcagcttgggagttaagtctctgccaaagattgcaaggaatggatctggggtgggtctatacatatatattttatctatcgatttatgtatattttaaacttttttcttttgagacaattatagatccacacatgcatttgtattttaaagtacgtaacctggctaagagcccttcccaataatccatcatcccctaaggcagaaagatgacacatctagttaatccttggttttctgaggtaatgggtggaagaagaggtaaataatcctatattcatttatatttacatttgttacatagtagattaataaatatctgatgactgagtaaatgtgtttgaccaagatagttacatgctgagactgacatactcctgtgtcttttccagcaagtaatgagaaaacagatgtaaaaatgaaaagggcaaaggcatggaccagcataacctggtttaaccacatgcctccactcaggccggtttgaatctctggttttctgcatgttttgctgtttcagctaatctacccagctgaacctttctccttcctccatggtcagcagtatctacacactgtccagcacttgactaaggggcatttcacatcaagcaaaggagaaagctgaatgggtgagccttcccataggaaggcaggatggatgctcaaagcgaatcaggtgtcaaaagtgactctgggaatgatggagagggtacagaatgtttcacttccactttgatactttcaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcaggtatagaaaaatgtctatttttaaacgggttgtcccactagaagagagtgcctagtgtttgtgattagatgggtatgtggctgccattcagcacatcgaatgcagagaggaagatggatttaatttggtgttgtttggctgcacagtgagcgtcatgagtaagaccaaaaagatcccaagttagaatcggggtaactaaagtaaagcagtaggaacttggatccaaggcaggttttgagaactaagtaagataagagaatgggaacatagatatcaccaacagaagaaccttccatgggagtccagattcacaccatggtagtgttagggtgacaagttacatgcaaaggccaggacttaagagaagggtatcctgggagctgagaccaaaagctgctgctttcaggtaacttcataaccctctccctcattgctttgggaactaggggatagggccagctacccttataagattacaactgcaagaccacaaaaacttttcgtgcctcggtctatctatgcttcgccctgcaagtctagacccttgctattgtcctcaccagggctgaacagctctgttcatcattaaatactgttagttgagttatactagacagtagtttgttaggttctactgatcagtgttcttcctgggggataggcctatttgaaagatcaagctgcagatcagaagctccctaggagagtggagatggttaagtttcactaagctttgcttgcctggaataaatcagggaatactgtctttctaggataaggctggagatatcctaaccacatatttcctcacgaccatctcttcctatgctccaagctggctctcctacattgattctttacttatgctcatccccaactctgtcacaaaagaaaaaatctcaatatgcatattctgaccaaaagtctggtcctgcttacctcactagcagtatgaccttgggaagattcctttccctttctcaacttttgtcccatctctgacatgaggagggttctaaagccccctcttcctcttgcattctgaggttctaagacaccagtctgttccctaaatgaaatgtcttgctttcctcagaccacaaaggtggcttctttccccccccatgcaaaggcatcatgagttttcaagggagaaaggccagttagtgcttcctgtgacccagctcctggctctgggccacgatgagtcaggactgcagcatatacctctgagcaaactcacgatcaagcttaatgttccccttcaccttccgggaagcgttctcccttaggcaaaagatacagatcagcaatggtaacgggaaaacacagatgctacagtgtgattcataaaggctaatgacagagaaagttgaaatcttgggtttcacttccttttttcttagttctgttattatgttgctttggcagcagcagcaccagcaaaaaagaaaaacccatacccatcccagtttgctccagtcaatgctgcatccccagtggtcccacaaataagcatgttctgtcaggaggatgtttcttagaaactgccacaagtgttaataccagcttaaatatctttgttggtgatccttggaaagaaagttcagaacatcagtctaatattcagaactgatcataggagggagagcatattgccagcttcagggagggacaaaaaagaatgcaaatgaagttagaggcacaaagaagcaaagaaggcagtgagatttggtgacgatcagaggaaccaatttggagccaaataatttcaggtgtaggcactttgaccagaatggttctctatagtcctaaaaccaaacttgtgaaagttgtgggcagaaagctcgttttaggcttagaaggaaataagtacccaatgtctaaaatatgtgccagggaagctgctttggggaaggatttatgtggaatgggaaagctctttattaaaaggaaatctaggggcagaatatatttctttctttctttctttcttttttttttttttttgagacggagtcttgctctgtcgcccaggctggagtgcagtggcatatctcagctcactgcaagctccgcctcccaggttcacgccactctcctgcctcagcctccggagtagctgggactacagaagcccgccac[182 bp omitted]tggaatttttgcaaagtgagattgtgattctttgggactgtaaatcatagcctttggtttcaggggagaagagagctatggccctgtatagtgacatggtatacatggactattgccttcagccacatcaaggaaatgaggggacttaaaagacatgcaaaggtcaaggggtcatgggaatcgaaggcctgaatgttaaatgcatcagtccaaaggacctcaacagaatattagaagtggaagagactacatagtagataccagcttgtaaaatcacattggctaggaggcatggtgtatctgttaggatactggttggtttgctttaacaagaaacaaaaatgactggagcttaaacaagatggaggggctaagtcttggacagttagggcagctctattccacaagagcattcaggcacccaggctccttcatcacaaaactctaccatccttaaaatgtctccctcatcctcttgattgagaaaggctgatcctcaccacgtccatgttctagctaggggaaagggagagaaagaggaaggcagagggcatatgcttctttcccagagcatgaccaagaggttacacatatcacttccctttacatctcattagccagaactttgtctcatggcctcacctagctgcaagggaagctgagaaatgcagtcttttttctgggtggctatatgccctgctaaaataagggggaaaatagatatagggtcaattagcaatctgccacatggagttgttctacctggggtctttaccttgagcatttggaactctgcagactgatgttcttggatgggaataggatgactccattgtgtttctctgttgcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaagtggttttgctttaatattctttctttcatagatcaatgactgtgtggttgaaatgtgaaaacaaagatactaataatgttgctgtataatttcactgacttgaggtctcattccaaatggttcaggttttatagagcattgtgtaaaataatgttcatacttctttctgttttaataatttattttttgcactactgtatccttttttctacatgtatgtttgtaactatttaagcgtacattgctgaaaagtccattgctttatttattgatgtggtttaccatgtacctagggggaaataacaatactagaagtgtgcagtttttgcttttatcttttttttactacaatgacactagttcttagaccatttccgtatctatccaaatggatgcttaaaagaagttcagaatgatgctaagatcatctgtcttcagagtccacttttttttttcagtttgaactaaacaatataaaatacttaagggatttggcctagattatggtatatgccaaggtaaagtaaaataattcattttctgtgtgtaatacagaacaaagctgaaagaattatttttattataggcatttacttcagcaatctaattgtacgtgtatctaatttttccccagtgcagttaggaatcggattttgggcaggatcataattaactcttcagaggaaatggtgttcagtttagcacatcacagtcatgcccaactagcctccataacccacctctccccggggttctgaggatcaagacctggacagaaacacttgataaggactttttattattaaaatgtaaataagacaaa[144 bp omitted]gaaaccctgtctctactaaaaatggatacaaaattagccaggcttggtggtgtatgcctgtaatcccagctacttgggaggctgaggcaggagaatcacatgaacctgggagatggaggttgcagtgagccgagattgcaccactgcactccagcctgggcaacgagcaaacctgcgtctcaaaaaaaaaaaaaaaaaaaaaaaaagggaaccagataatctattattttacctaagtactgcctttgcttctagttgcatgggtgaaatatttcaatgtatggggagaatatagggtgaggagtaagagtaagccctgatttagcttgcttagtgctagtttgagtccttcagtggcaggacagcctgtaaagtaccacaagtatgggagtgttataatggcagagtgaaacgattagagcagggaggaagtgaattgtgccattagtaccttcatgcaaattataccatgtgattttggacagtgaatgatttttgcatcattcattcacagcccatcactctgttaaggtgagagtgtaattcttacttctcccatcaccacctgtagctagaaacaggaaagggagaatgagatgatccagacaacataaaaaagatgcatgtaagcagaaaccagatggtcttttctgcactcacttaatggacattatgttgccagagtgttgtgtttatcagatttgatgtttggagctagtctgggcaggtgaagaacagaaataggcggaagtataggcattatttctgcgcaagcaaactccacaaagctcagggagcagaaaagactccccctcccacctggttcccagaccatgtggtcataacacaatcctaatagtttctggttatctagtgtaaatgcaacaaagaaaaaggccctaagcttctctacttattagatatattatttttggcaattgatttaacttttgccaaccctcagttttctaatctatgaaatgatagtgataagttctgcatatagggttgttacgaaaattaaatgagataatgtgtaaatcaattagcacagtgtctcacacctagaatgcactcaagaaataatagctactattagattagtcatagttatagaatatcatcaagggcctacatttgtataaaacactgcctttacacacaatatccacttgaaacccctttaaacttagttgggggaatacataccactgatttttggacccataatttgatgatttacagataattcttttgggaattaaatgtgtgtgaaagtgaaataactggagaacaaatgagggtcagagatagggatcaatcctataccagaaatttttttcctgcttcaataagggctagaaggtagtgccctatgtaggtctaggatttctttcttccttccttccttcctttctttttcttttgttccctccctccctccctctctctctctttccctcccttccttccttcctttctttttcctttcctttcctttcctttctttcttttgtgtgtgtgtgtgtgtgtgcgagtctgagtctcactctgtcacccaggctggagtgcagtggctcgatctcagttcactgcaacctccgcctcccaggttcaagtgattcccttgtctcagccccccaagtagctgggattacaggcacgcaccaccacgcctggctaatttttgtagttttagtagagatggggtttcaccatgttggtcaagctagtctcgaactcctgacctcaggtgatccatctgcctgggcctcccaaagtgctgggattacgggcgtgggtgtgagccaccgcacccagcctaggatttctgatagaatggaagccttaagttctagctccattagaataaccaacttttcactccctgttctccaaaatgtattgagaaccttacccatcccagatgatgagagtttacaatctgtgacttctgttcttagttgatagtatttctttatgttgcccaaagtaacagattcaacaaaaaatgtactgagatccccatgtaccaggtactgagccaagtgatctcacatacctgagctcattacatcatttatttctcataccaaccctgcgagagcagttattatccccatattatgaatgagaaaactgagcctccactatgttaaatattttgtctagttgcaaggcaggatgcaaggctaagctttggctttctttgggatgtaccttaacgaggtaatcaattggtcttgaacatttttacactgggaaattggttttgctgcacagcttgggaatgaagggtatacagaagaaagacataaggctaaatctaggccagaaaaataagacttcccccacagtagatagtgccacttatttagttagtttttctgtctatcatgactgacccagtctttgcctagtaggttatattttgtatgtatgtatgtatgtatgtatgtctttgtgtgtgtatgtgtgtgtgtgtatgtgtgtgtgtatatatatatatatatatatatatatatatatatatatatacactaggtagcaagcagacatcatatctttctgctttgtactgtactactgctgctagcaaataaccagcaaaatgtagaaaatgaaaaaccaattttctgtagacaacctggagaaaagagtgcctgcccctgacttagcggggcagagaatgacaatttttaaagtttgccttttctgaaggttgcttttagcccagtgctgcctcagcagcaaggggcaagcagagtcattgcgcatgtggcgcttccagctctacctgtggagctggcctgggctcagataatcccctgtgactggccattggagcggcggagctcctgaggctagttcacagcacccagaggtctcttacagtcaacagattgcatactgttgacagactgcaatccgtctgtgttccccacaccaactccatttccaagatgggaattttattcaggaactcatttttgagttcccaacatgttgacttcgcatccatttctgctcaccaaggcagaaccatagcagtggtgtgtgacaaagatgcaaatggagggcagcccaaacaatggaaaagagaagattttcagcccattcttggggctaagtgaggttttgatttatggtagaagacagttctaaaaagcagctggcagcatgggcttcaatttgtggcccttctgagttcaaacagaaggaaggaaaaggagccacataaagtgtacacattcaattcatcttagaatgatagctcccaccttattacactgtacaactatttaataatctgggttacacacatccagaggtgaaataaagaaattttcacttacaaatgtgtatttccaaacatgctaagttaacctccagagagaagtgcctgtaatctctgttcctggtgtcactttaaagcttttgcttcatgactgtagctgttgtttaaaatgtttttgcagcaaacgcgatttaacagaagtttacaaagcaacactgtagctaatgcataattttaaaagttgactaacatttatctattgttaaagcaacactaataatggaataaaaggaaagcaaataggccaatgtggcaccataggcttattttaggtaaattagttccatcatcttatgcagttgtaagtaatgccaggattaaaatatcaagcaagccacgtaaacagtggcaaatgtgtgtgtgttttccatttgtttggtaagcagccattttactcttgcactgtaatgaactgaagggaaatataagataatgcttttttccccccatattgctattcaactacctctatatgcttgatttctttttaggattcccatcctccaaatctgtacaaaaacgtttcagctcatctgtgttgtaataacaatgtgatacagacagtttgtgtgaaagttgtttgttcattaaaaaatgtttcctattgcctcactttgtgtccaacaaaactgtattcctaccttaggaaaagaattatccaactagcttcagtatcacttcggtggaagctgaatagaaaggaatgcttcaggaacatctatttgttcttgttcctattggttgtaataccagaagatcctttaaagaaatatacttgcattcagacagcaaactcccatgtatgtgacagcgaggcaggtgtgaactgattaatgtgactgatgtgttctgaaaaactggccataaagtgtttcaaaatgcaccagaaaagcttgttacataaagaattatgttgaagcattttgtcaatatctgcccctactttatatgtaaatccaagcattcacatattgggtttgcttaaagcacaacacactgcctactattttctttggcatcataaaatgttcaagaaaacaaataacacgtttttattttaaacaagcagtttattaacaataggctaaaagctaaggccccaaacatgaaccttttaacaggaaaattggtaacatttgtgacaataagtgatactgaccaagctgatcccagcagaagagcttcagcaacatcccatcttctctacagtactgattttagtcttatgctattgataacttttaaatgagttcttaccgttgagggaagaaggacacaagaatgggacaattaaaaatgaaatgatagaaaattccacttgagcttgatcttattctgtgtaacaggaccttgggggatatagaaaaaaatcagaactcctgtccatctaggccccagaggaaagacttggctctgttagacttcatccttctgtgcccagtctgccactcgctggttcttaagagatagagtacacttaaaggcacaagccagtccttccaagacagtcctgcccagaatccctgcataatttttctctggagaaccgaattgagccatcttaaaagaagcttctgtttgcagttgtaccccaggcctttgttagaaccaaagccaacacttactgcatcctctcttctgggatccactctggctttttttttttttttttttttttttgagacggagtcttgctctgccgcccaggctggagtacagtggcgcaatcggctcactgcaagctccgcctcccaggttcacaccattcttctgcctcggcctcccgagtagctggggctacaggcacccgccaccatgccctgctaatttttttgtatttttagtagagacgggttttcaccatgttagccaggatggtctcgatctccttacctcatgatccacccacctcggcctcccaaagtgctgggatcacaggtgtgagccaccacgcctggcccactctggctcttttgagttctccagggccaaagatgcctccctagaagataacaccagttgaaaaacgagatatgaacaagagaaaggaaggaaaaatgccctagactcccagaagcctaaacttttccgtgttctcttatgttttatgatttcttcattcccaggagggcctgaggtgggatgggaaggggctggtgtcagtactccccatattgacttcttcaggtaatgtagatttcctagccagacttgtctgtggtcagctcaatgcagaggtatgttctggtcaaggtagagaagtgtaagttctgaggagccctgcctctgtatctctgaggccccttctcccaccctttacagtttttggttactgattttcccatttcaacctatactcacattgactggtcatacacgtttcctgtccacttacacacatatattatcaaatgtcatcgttgcattacaaagacctgaaaaaattctactccatttattgaagtacggcctcccaaattgcacccctttgcagaatacttcctaccttctagtaagtcaatatcaacaatttctggacactacaaatgctgcaaagggccgaaatagcccacttgccctaaatccagttttgctacagaaatcttgcttctcttggattttagaagggcattatggtgatattcgatacagtcatgggaacaggggagatcattgcacctttggcctatcaggatgtctgttgccactggtagaaggcaactctacagtctcaggactgtgtgtttcttctgcgagctgaaatgaacactctcataagaagatagttgttattagggaagggggagcagtatgtccacaaatggagttaagcccttctgcttaagcagtctacagtgatgagctcccattggacagagaaaaggatggggagaggaaaagaaggaaaagagaggaatgaaggcagagaagggttaaatggctaattatgagagtcgaagtggttaccttttcatctcctggccggaacatcatgtatcctcttcccatattaactgtggacttgatcttccatcctgatttgggaagtcacttatgcccaaactaagactgcagtcatgtcttcagaaaatatgagccatgttcttgcaccttgtaggctgatcccagaaaggacagacagtgtatcagcagctcctcattgagctggtcactgatccaaaggccaagccagtgtccattgagtgttcattacgtgccatgtttgtttctagaatttttaacattcttcttagaaataataatctgtggccaggcgcggtgactcacgcctataatcccagcactttgggaggctgaggcgggtggatcacctgaggtcaggagtttgagaccagcttggtcaacgcggtgaaaccccttctctactaaaaaaaataaaaataaaaaaataaaaattgccgggcgtagtagcccgcacctgtaatcccagctactcaggaggctgagccaggagaatcgctggaacccaggaggcagaggttgcagtgagctgagattgtgccactgcactccagcctgggtgacagagcgagactatgtctcaaaaagaaaaagaaataataatctgtgaagtagagctcttcacaataatctgaagtagagctcactataatatgtgaagtagacatcttgttatatacttgttataggcaagtaaactatggcacagggtggttttgttacttaccaatggtcatgctgattaagatctgggccagagcccgcatggattccaaagcccacaatcttacccactgttacgggccgcccattgtgtagtgccacagacccaagagaacaactcagttcataaatgcaaatcgaaactacgatgagataccatctcacaccagtcagaatggtaattattaaaaagtcaagaaacaacagatgctggtgaggctgtggagaaataggaatacttatacactgttggtgagaatgtaagttagttcaactattgcagaaaacagtgtggtgatatctcaaagatctagaaccagaaataccatttggcccagcaatcccattactgggtatatacccaaagcaatataaatcattttattacaaagatacatgcacacatatgttcactgcagcactattcacagtagcaaagacacggaatcaacccaaatggacatcaatgatagactggataaacaaaatgtggtacatacacatcatggaatactatacagccataaaaaggaacaagatcatgtcctttgcagggacatgcatggagctggaagccattatccttggcaaactaacacaggaacattgcgtcttctcactcttaagtgggagctgaacaatgagaacaatgagacacagggtggggaacaccacacactggggcctgtcagaggggtggtgggagggagagcatcaggataaatagctaatgcatgtggggcttaatacctaggtgtcaggataaatagctaatgcatatggggcttaattcctaggtgatggtttgacaggtgcagcaaaccaccacagcacgtttacctatgtaacaaacctgcacatcctgcacatgtatcccagaacttaaaattaaattttaaaaaaatgtctggtggagaacgtccagtaatgttgacagcaaaacaacagcaaccatttattgaatgtgaactaatgtgctgtgcactgtgctaagcattaccttatttagttctgaagtcggtgctattattacccagcttttacacggcagctcagaaaaataaagtgacttgttcaaggtcatgtggttaggaagcagggaggctgggcttgggatccaggctgtctgccccacagctgttgttcttactcactctgtgagttagggtgcctctcataaagcccaccattctcctcacttctcgggccttgattcctgtgccttatcatattctaactctagtccctccaaacctgcctcctcttctgtctttggggtcctcctccatgaaggcctctctccctaatgactacaagctctggggccccttgattatcaacacagcttgcccaacttgttcttctccctactcacctctgtggccgatttgatttatttttgcattaaagaaaaaataggagtatagatttggagattcaaaaggcaaaataaaagataaacgttgaaagctacatacatacagatgtatgttctagagtcatacatcccagtgtgtccggaattggtgggtttggtctcactgacttcaagaatgaagccatggatcctcgcagtgagtattacagttcttaaagatggtgtgtccggagtttgttccttcagatgttcagatgtgtccggagtttcttccttctggtgggttcgtggtctcgctgacttcaggggtgaagctgcagaccttcgtggtgagtgttacagctcataaacgtggcagggacccaaagagtgagcagcagcaagatttattgccaggtgcaaaagaacaaagcttccacatcctggaaagggaccccagcaggttgtccctgctggctagggcagcctgcttttattcccttatctgacccccacccacatcctggtccattttacagagagctgattggtccgttttgacagggtgctaactggtgtgtttacaaaccttgaggtagacacagagtgctgattggtggatttacaatcctttagctagacacaaaagttcaccaagtccccactagattagctagacacagagcactgattggtgcatttacaaaccttgagctagacacagagtgctgactggtgcatttacaaaccttgagctagacacaaagtgctgattggtgcatttatgaacctttagcgagacagagagttccgattggtgcgtttacaatcctttagctagacacaaaagttctccaagtccccaccagattagctagacacagagtgctgactggtgcgtttataaacctttagctagacacagagtgctgattggtgcgtttacaaacctctagctagacacagagtgctgattggtgtatttacaatcctttagctagacagaaaagttctccaagtccccaccagaggcagaagcccagccagcttcacctttcagtggccctcgccgccgcgggactttgcagcacctagccctggcactccggcagcccagagggagctcgtccccgatcaagcccaacaggtgccggcgcccacctggaacccacgctggcccgtgagcgtgagcgctgcgtgtagcctgctcccctctacgcctctccctccacacctccccgcaagcagagggagccagctccggcatcggccagccccagagaggggcccccacagcgcagtggagggctgaagggctcctcaaacgccgctgaggccgaggaggtgcccgagagtgagtgagggctgctagcactttgtcacctctcaccagtgctgagggaggccttaagaaatcattcagcccagctaaatctcctgctttcagccactattatttttcccattttgcagataagagaactatggttgcacaacagtgttcaagatcactccatgagttagtggccaaatgagacaagagcctaaaatgtaatgcacactcaacacactagaagaagctcacagctggccctccccaccccgagtgttctgatgtgtggcttcttggacatggaactttcattgggaagaacaaagaattttttaaagagctacagcctatttggaaagtcccctttagggactgttctctctctgaccctccctgacccaaacttctctttagattgcttccctgttctaggaacctttctctcacacaatctgttacttaggagaaatcttccactccattcacagaagtttgggtttcatgaaagtgaggcagactgcttttggctgaaaaagaggaacctcatgcctgccaactcacacaccctgtgcccccagtcattcaggtgatcatggaaggagttggaatggctatcacagttatgagaggtgacagcgtgctggcagtcctcagagccctcgcttgctcttggcacctcctctgcctgggctcccactttggcggcatttgaggagctcttcagcccaccactgcactgtgggagcccctttctgggctggccaaggctggaggccactccctcagcttgcagggaggtgtggagggagaggcaccagcgggaaccggggctgcgtgcggagcttgcacgccagctggagttcccggtgggcgtgggcttggggggccccgcactcagagcagctggccagccctgctggccccaggcaatgagggacttagcacctgggccagtggctgcggagggtgtactaggtcccccagcagtgccagcccaccggtgctgtgcttgatttctcaccaagccttagctgctttcccgcagggcagggctcaggaactgcagcccaccatgcctgagccttccacccactccatgggctcatgtgcggcctgagcctccccgatgagcaccaccccctgctccactggcgcccagtcccatcgaccacccaagggctgaggagtgcaagtgcatggcgcgggactggcaggcagctccacctgcagccccggtgtaggatccactaggtgaagccagctgggctcctgagtctggtggggatatggagagtctttatgtctagctcagggattgtaaacacaccaatcagcaccctgtgtttagctcaaggtttgtgagtgcaccaatcgacactctgtatctagctgcactggtgaggccttgcagaacctttgtgtctagctcagggattgtaaatacaccaatcggcactctgtatctagctcaaggtttgtggatacaccaatcagcaccctgtgtttagctcaaagtttgtgagtgcaccaatcgacactctgtatctagctgctctggtggggccttggagaacctgtgtgtcgaacctctgtatctaactaatctgatggggacctggagaacctttgtatctagctcagggattgtaaatgcaccaatcagcgccctgtcaaaacaggccactgggctctaccaatcagcaggatgtgggtggggccagataagagaataaaagcaggctgcggagccaacagtggcaacgtgctagggtcttcttccacgctgtggaagctttgttctttcactctttgcaataaatcttgctactgctcactctttgggtccacactgtttttatgagctgtaacactcaccacgaagatctgcagcttcactcctgagcccagcgagaccatgagcccaccgggaggaacgaacaactccagacgctctgccttaagagctgtaacactcactgcgaaggtctgcagcttcactcctgagccagtgagaccatggacccaccagaaagaagaaactccgaacacatctgaacatcagaaggaacaaactccagatgtgccaccttaagagctgtaacactcaccgtgagggtccgcagcttcattcttgaagtcagtgagaccaagaacccaccaattccggacacagttacgactaaaatcagactttgggatcctgatccagcatagacagcccttcagcctgcagtgctttccactgcatttattaattcattaatccatccatcaaatattactacagtgcagtggttgagatcacagaccctagagttagactgtttaccttagaatcttgcccccaccacttactatctatgtgataaagaaactgttcctgtttccacatctgcaaaacaattgtgtctacttcatagttcaggtcatcaaaatatttcctgtaattttcccacccaaaatagacatacattatctttttaaacaggaagacaagaagcaagagatttcaggactggggtcacaggttcaacaatcccatccaagtgcctggtctatctttcctgaatgtttttaaagccccatggtgaagtagattcacaaaagcagcaagtcaatccagtcctttctgctggggaccagatgccttaaagggagggttttttgttggctaacaggtctaaacccacagatgaaggaatttttaaagggagaaagggggaattctagtgctcacgcctacctcaaggttcaaatgtgaggatgttcacttacagaaactgccaggaaaatagaggctcagctatcatggtaattcttagtccaggccctaaaagggcattaacatctctaatttattcatttattaatggaacaaacatttgcaggacacatatcatatgctaggcattgggctatagagaggaatacaacactatccctgcccttgagaagtttgcagccaaaggaagaaaacacggacttattcattacacagggcatggtggtggtacctcacaggaaaggcacctaatgttgcctggggaggtgttcagggagggctttgggaggaggtgatgcaggagctgaactcagaagaatgagatgctttccacgtaagagagtagagaagggtcgaagcagatgagagagtagagaagggctgaagagcactccaggcagacgcaacaactcatgaaaaacatctgatgatccatagagagagaattgaccagtcgtgtggaatgttatgagcagttcagcctggtaacgaacagggcttaaggtatgcaagttcctgacaggggagcagggcctggtttctcacggttttgtttcattccaattaaaatctggtctccaagggggtctccaaggaggtctgtgcagcaggcttttgagtgagggggagagggttggcctatgagagcccagcttcctggccaagtcggtttaatgggtagccaccaagggagtccccttggcacagcctgatgctgggtgctgggctcaggaagccccttagggtttgcacaagaggaagagaagtggtagttggtgatacagacaatttttgaggagtgattggagtgttcagaagtgggggccaggcacagtggctcacacctgcaatcccagcactttgggaggctgaggcaggcagatcacttgaggtcaggagttcgaaaccagcctggccaacatggcgaaaccccgtctctactaaaaatacaaaaattagctgggcatggtggcatgcgcctgtgatcccaactacttgggaggcagaggcaggagaattgcttgaacctgggaggcagaggttgcagtgagctgagattgtgccattgcactctagcctgggaaacaagagcaaaactccgtgtcaaaaaaaaaaaaaaaccatagaagtggggagactggctgggaagggaggaggaaagcaagcagttggcatgactagaatcgaggattatgatttatatgacctggaggctttgggataacggacccagatgaatctcttcaccttgatcaaccaaagacaaaccagggctctggcatactagaactggctcatactagctcatgagagctgatcattaagacttcaaaaattttgaaagccagctgttaaacacagccattatttaaaaaaaaattatctaaacttacaattaagtaacattaaaaacaaagtaataaatactcaaaacctattgcttcctaattattttactacttttaatgttatctgtgctcttgaaggtatttaggtctactgcatctgtgtggtggcaatgctactatagaatggtgtgccgctaagcagctcttcccaactccacgttcagtgatgtcagggtggtagctgaaatcggcaaggtgggagtatttacatcacactagaaatgaaggcacgcctcacagagaactggttgttacatttttccagcacaccactgcctctgggcatgcttcctttctctgtctttatgcttacttccaatgccaatagggctgttttcaggaaaaaggaacccccgcaactaattcacatggatatgtaaattgctaagagtccagatttctggtcttggtttttaggtaatttatttgcactttaacagagatctgccagagacaccatccataatggtgtggttgagagatatgttattgaaatgtgcgtaataaacaacactctcctacatttttgcttacggccatccctccagctcacccccttcaaaccacaagatagaaattatttcccctgcctaggatttcagtggaataaagcagttgaatccctcatcattcatcccactaaggccatgacaagatggactgagaggtccccagcccaggaactcccagctagagaagtttctgtgcaccaccacgacacaggggtaaataacaacaacaacaacagcagcagcagcagcagcagcagcagcagcagcagcaaatatgtatttacagcttcctatataacaggcaaagtactttttaacacaacagtccaataggtcaagtactactatcatccccattttatagaagaggaaaccaaggctcagagaggttaaggaacttgtttgaagacacacagcaatggagcagtggagggggatctgaatgtgggcaggctgcttccagagcactccttcttcgtgttagagaactttctcccattaaagttgtcctcgtggctcttcccatgttgggagaaaagctgagtgttgggagagaagctgaggcagggcttgcatgtctggtagacttgctggccccttgcttctagcactcccattatctcaagtagccatatatttctcattcacttgatacactgtttcctttcaacccccacatcctcaccaactgtttctttgatcaccaataaatagggtgagctcccagagctcggggcctttgcagcctccatactcacgatggccccctggtcccactttcaatctcaaactttttctcattcctttgactccaccagactttgttgcccccatgacctggtgttgggtctgatcaccccaacattcccatagctcagcccagactcattgctgctctctctgaccagcccatttcctctccctgtccattgtgggccagcacacctggaaactttgattggttgctgaacttgactgttataaatgagaaaattacagaagctgagaaagtcccaggccattttcattttacgatctttctaatgtattaaagcagacaaatgaacaaacaaaaaatgaggaaatgtcaaagaaaaagttagaaaatatgtggaaatatcatgcctgtaatcccagcactttgagaggctgaggtgggtggaccacttgagctcaggagttcgagaccagcctgggcaacatggtgaaaccctgtctctgtaaaaaatacagcaacaaaaaaaaattggccaggcattgtggcacgtgcctgtggtcccagctactcgggaggctgaggtgggaggatagcttgagcccaggaagtggaggttgctatgagctgagattgcaccactgcactacagtctgcatgagagagtgagatcttgcctcaaaaacaaataataataaagataacaaaagagaatttgtgaaaatacattcacacatttaatacacagcaacttaatgcaatataaatttgctatttataagataaacggagagttgttcaatagggatatttttggttttgcaagataaaaaagttctagagatctgttgcacaacaatgtgaatatagttaatgcaactgaactgtatatttaaagatggctaagatggcaagtttaatgttacatggtttttaccataattaaaaaaaatctttttgtgagtattaaaaaaaatgaggaaatgccaaagataaggctgcaaatattgtggtaacacatttgcgcatttaatcacagagcagtttaatacagtataactttgctctttgcaagataaatctaggatttatataaaaattaatttgtcctgcattatatgcagtgtggtctggaaaggaaacacaagcttaaatgtgtttgttttgttttttttagacaggatctcactctgtcacctgggctggggtgcagtggtgtcatctcggctcactgcaacctcctctgtgcgggctcaagcaatcctccagcttcagcctcccaagtagctgagactacaggcgtgtgccaccacacccagctaatttctgtatttttcatagagatagggtcttgccatgttgcctagcctggtctcaaactcctgaactcaagcgatccacccacctcagcctcccaaagtgctggaattatgggcgtgagccaccacgcctggccacaaggttaaatttgtatgatgaatgttgtctctgttcagtcctgtccataaatctctgaatgtatgaaagatagccttttttttgtgagataacctcatagaggcccttcaagaatgtaaggccggcttggtgtggtggttcacacctgtaatcccagaactttgggaggctgagtagggcagatcatgaggtaaggagttcaagaccagcctgaccaatatggtgaaaccttgtctctactaaaaataccaaaattagccaggcatggtggcgcatgcctgtagtcccagctactcgggaggctgaagtaggagaatggcttgaacccgggaggtggaggttgcagtgggccaagattgcaccactgcactccagcctgggcgacagagggagactccgtctcaaaaaacaaacaaaaaaaaaagaatgtaaggccttgatcaaatggcttttccagctgccctctacacatttcacccaacacagggcttgttgcagcaaaaggcctgccacgagtactgtctgctgcacttggcatcacagcgccagctctcactgtagctcatagaggggcagcacaagcatgaaagtattgctgtatctcagtgattaccaccacacacagatagtggaacactatctgctctccagaaaaaggcacgcacacacacacacacacaatttttgcatgcactttgcatacagtctacagacctcccctgaatcaatgtgtactctggtataaggctttctacacactaaagtccacagtccttaataggaagttctaagccataactgtttgagactatcaaggttgcattaacatgagagccccataatatttcaatatttgttggtggctaagtatattaggacaacacgctaaatttggacttatcccaaactcccactttcccagtctgacaagtttggggactgccctctccaccccttctgacttagtctcccaggcatgctggctatctagctatagcctagaattgactcagcaaataagcaaatgtaaatactcactgaatctttctggggccattctgtggaaacagaaatatatttaagtttttctgcctttgagaaaacactgtagggcatatccctgggcagatatatttggtggctcttagaccccctgacatacacccccaggccatcctcatctatttgctttctggcttctgatctgggcccttcctgggaatagtttttctctgaccctagagtctagaccaaagccaattggacattcacttcctggtgttttttttttcttttttttttcacatttgtctggtagtttctgtcctggcttccccatacttgggctctcctatcttggattcataattatatttctagccactttttctttctgactcctttagctcttcttttctttctttttttttacaattatattcgtataaatttaaggaggacaaatgcagtttcattatgtggctacattgcatagtgttgatgtttaggcttttagtgtatccattacacatatagtgtacattctacccattaagtaattttttttttttttgagatggcgtcttgctctgtcgcccagactggagtgcagtgacactatctgcgctcactggcaagctccacctcccaggttcacggcattctcctgcctcagcctcccgagtagctgggactacaggcacccaccaccacacccggctaattttttgtatttttagtagagacgggggtttcaccatgttagccaggatggtctcaatctcctgacctcgtgatccgcccacctcaccctcccaaagtactgggattacaggcgtgagccactgcgcccagcccccattaagtaatttcttatccctcacccctcttccaccctcccacccttctgcctctccagtgattattacacattctatgtccatgtgaatgcattatttagctcccacttgtaagtgagaacatgcagtatttgactttttgtttctgagttgtttcacttaatggcttccaggtccattcattttgctgcaaaattcataattccattctttttatggctgaataatattccattgtgtatatatatcacatttcctttatccaatcatccattgatggacacttagtttgattccgtaactttactattatgaatagtgctgtgataaacgtgagtataggtgtcttttggctataattatttcttttcctttgggtagtttcccagtgggattgctggatcaaatatagttttattgttaattctttgaggcctttcattacggtggggtttttttgttctccctttcccctcaagtagcctctgaacattacatgcctaatcatcctctccctggctcagctgatggtcctagcatctcccactgatgggctttttcttattctcctgaagagtttcatatggcttcacaagatacaactgcattttgatcatgattctcattgatttctgctttgcagaaaacaaacagacaaaaacctcacaactcaggaagccacgttgatatattttttaaaagtctagttctgactatttttctattctccattggcttttactattcaaaacccctcgcttgccagcagtagcattacacctatccccacctctcttagctgtggggctaaaggatagaacattctatttggctaaagagaaaaggtaatcagactgagcccagagatgtacacataggggctcataaacaaaacaacctcgtttcactcttttacagcagaattttagctaggtcacttctactaacagccatctattgggggaaaattaatgactatcaatttacaaaacaggattatggaaaacttttaaatgagagctagatagagaaactcttgggttaacgctcctcagtgacctagaagtatatcgaaaaaacaaaatagtgcatttctgataatgaaacatgacaaccgtacctaacctttttaaattaacagtggtgcatatatactgtgatcttttcaagggcagcaggaccacatttgaatcattttctccataggttatcttgaggaacatgatagtcaaatgtccctaggcatctccacccatctgggctttgggtcatgaattgatacttatacaggaactagctgccattaggtggagcaatttgaagtctaataggccatctagaaggatatcagatcaggaggtttaagaactccagatgttttaatttaggtgagtgcagccacaaggctgctaggacattaacaaagaactgattgatagagaagaaaaagtagctggtattagataatggtattagataaaagtagctggtattagatgatgggaggggcctgacgtctggttgccaaggcacctaactcttcactcgatagtcccccaagcacaggattcatggcttttgtggccccatcccttgggcgtagagcataatccttagctgacctttgaaaaatgcaacctcaggcttgcccggcttctggtacttccaactcttctttgccattattataaacacaattatcagtctttgaggggaggctgatcttttagttcagatttccagagttcagattggcaggtgtcctttgtcatctcataaaggaattaaagtgacctgagaaaatgtcctctgggtaagatcaatgccacctgtactctgtccttgcccaaactctttcatcagagctctcatgtgcatcagcccttccccactcccttcaagcctgtacagcctgggcatgacaataaatttggtcctttagcaatagcatgtacaactcccaggttattgtctatcctttttgagaactcaataggattattattatttgagacagagtgttacccttgttgtccagtgggagtgcaatggtgcgatctcggctcactgcaacctctgcctccggggttcaagcgattctcctgcctcctgagtagctgggattacaggtgaccatcgccacgcccagctaatttttgtatttttagtagagatggggtttcagcatgttggccaggcttgtctcgaactcctgacctcaggtgatcgacctgctttggcctcccaaagtgctgggattacaggtgtgagccaccatgcctggccaggattatttgattggaaatgtgaaaataagaaacaaaacaaaaataccccaggagacaaattatatttgtctaaggtagaaggcttcgaagtattccccactgtgaaagaaaacattatacttaaaatatacccaattcttcattgaatagttgatttaacttttttttaatttaactttttattgggggaaaaaaggtcagtagagcaaaggtttctatagcaacctggcagccgcacctctggtaacctatgaaataattaagttgagaggtgcaactaggtcagagaagagctttatgggaatcggctgaccaatgagtatataattggaataagtgaagatcacagcccactcacccaggaggaagcaagtaggtctttataaaggcccgaggctgcatcactcttccctattatcaggagggccttcacctggggtgagagacaaggcgtgtgcatgttgtgcctatgttttcaggatgggaagtggtggggaagtgcattaaagaatgaaaaaaacaaaacctaagaaaacagaaagcttaacagaaacatgttgttcctatgttttcaggatgggaagcggtgggggaatgcattaaagaaggaaaaaaaacccacaaaacctgagaaaacagaaagcttaaggtttgagttagaagtctggcactacccagactagacgatccctgctgctcctgctaatctggtaagagtgggcaggcctctttttgatgggggagaagggtcggcggggaggcctattgttattcccctataaccggctggacttgggagtaaagcgatatgtggacaagaaaacaggaagaccaggatgggcatgctggcagttacaaaaaacctaggcttgggaacctgaaggtttgccaacattaggaaggctgagctatccgagagacacattcctttcagtcctcattcttccctatcctgcaacctattccaaccactgtaagttcccattatgcctacaagtggcagataaaaaactggtacttaatacagagactgctggaaatgaatacccaccattaggctcttttatctcagcaacacctctgcaaaccggatgcaaatagattaatcaacccagtttcatttaatgtgggaattgcagagcatcatacaaggcaactgttttcttttgcatctgctgaagagcacgagggttgatttagaaaaaaattgtttccagcctgggtcacacattgaaggagagagagatggattctcttttctcagcatcctgtgggaggaaagcctgtcgcctgatccacatcagtcctatcataggggtcagggtccccattctcaccaatcatgcaaatgccaaaagaccagtctgggatgctgcccaacttcttgaccctgaaaattgctttcttgtcaacatcattgctgtctcagaacgcacctctgacctccccaatccccaaacagcacacccaggtggcttattcgttacctttgatcacatttgtctgagagaaggtaggagtgcaggactgaagaatgtgtaactctgggggagtagtggtgagagaggtcagttggggataacaaccagagctacagcactcatgcgttggctctaatactgaagtccagggtcatttccagcttgctgagtgaccttcagtcctctatgagtcacagctgcagctgagtcataggcagtgggagacaagctatgttttccgcttctaggccttcttcctcatcccctcccatactcttcccagctgattgaggaaggagctgtgtcttctattattattatgacatttgatggcttcggagtcatacagatttgtcatttaccacctgtagattacatcctctgtctgaggtttaatttcctcatctacaatgaggagataaaatggtgctttataatatgtcacaggattatcgtgaagtttaaagaagataaatcatgtaaaaaatgtctcaaagtccctgtcacacagtaagtgctcgaagagtgtgaatcattattaaattactcccccaaatcattttggaagttaaattagttgatgaaatctaatcttggagtcactgctatatagaggtaaatagaaggttatctccactgtaaatcactaaattggccatgtgtgtttaaaatccatttattatgagtttgattagtgataattatctccccagaacctcatcaccctggaagaggaggcagtgatctaatctaatttctgcatcctaaaagctgaggatcaaccctcagcacatgttgacccaatcgaaggccacatatcccaaaaagctaggcatgaaacaacacatgggcttctctctgagcttccctaatgcttggtaaggagtgtataaatgcattaactaccttctaccatgaatgtagtgactatcttctattaactaccttgttagacttctgttagggtctatcccagggttctctgtgttcatactaacggaatgatttgtgcagcccatatagaagatgatgtcattgttcatcactgtcagtataacttgacctttgaccacttgggtgctccctgggttcttctgcacacttgaccttttaggcatcccttggatgccctaacatcatactcagctctcaatggaactgaccagctctcaaattgaaggctattttgcgaggttcgttctctggaaacagcacattaatcaatatattctttttttagacagagtctcgctctatcgccaagggtggagtgcagtggcacaatcttggctcactccaacctctgcctcccaggttgaagcgattctcctgcctcagtctctggagtagctgggactaccagcgcataccaccatgcctggctaatttttgtatttttagtag[152 bp omitted]ttgttttttttgtttttccctcaaaagaaaggaaactctggaagtgagcttctatgaaatgttactaagtctttccatgacagatacagagatctaatttcagggcagtgagtgcttttaatatcccccccaaatcagtgaagaccaattcaccacataacttttcaatctcagattgtagtcataggaaatagaaaggcttccagcctccagaggaaacttttttcccccagaaacaaagcttcagtaatggcacacacacacaaaaccaaaggcaagatctgtgcggatattttaattgttctagacacagtcatcaaagaactatcatgtgggcacccctgaagcacccccatgtgttccaaatgcaaagagtagagtcacttaaatgttgacaataaggtgtggccttgacagcctcattgggcatactaatgacatacagcctgtgccaaccttctccaacaggttattccagggttcctgttgtactttacccctcacaacagactactgctatggggagaaatgtgctgcagtgctggtgaggagcctgtattttcctctgataacctcatggacatttaatccaataatttatgggaaaacatttctgtttcctgaagtttggagtagtagaagtcagatagagtggacttttcagcaataagggggttatggaattgtcgtggaatgatatttaactttggaagggctcgtatgtccacatttttaacaagtgaataaactaagttctagagaggttttgtcatttacccaaggccattatgtttatttagtggcagaatcaggactagaatccaggacccctgatacccaattcagtgccctttccaggacagcatgcaactttccactgtaatatcatttgttttaccttaaataataacagctaatacttattgattactccctatttgccagaattgcactaagcacaaaacaaatgctaggaggtaggaacttttattttctccactttatagatgaagagatggaggtttagagaggccaagtaactggaccaaaattacacatcacactgcacaactcttttaatgtttaacttactaagctaaccaatccaatccaagaagaccactcagactagagaagatacttacattgaccagaatctataaggcagaatgtcagaaatctgcgtacatttttaaaaatttttatcctgaaaagataacttcctgtgttaacacaagtctatttctgggagattcttcccccttctgaatgctctcattgacattcaccactatgtttaggattgggaacaggatgagcctttacaaatgtgcacaagttggaattaagagtgggcaggtagagatttgagaattgaaatatacatatttttttagacagtcttactctgtcgcccaggccggagtgcagtggcatgatcttgactcactgcaacctccacttcccaggttcaagtgactctcatgcctcagcatcctgagtaactgggattacagaagcgtgccaccacgtctgaataattcttttttgtatttttcgtagagatggggtttcaccatgttggccaggctggtctcaaactcctggcctcaagcaatcctcccaccttggcctcccagagtactaggattacaggtgtaagccaccaaacctggctgagaattaaaatattgatcaaacagattgagtattctgagctgctcagaaaagatacatttatttattccatttgtcatttccaactcttcatgaatcttcttctgtcgatttttggtagaataaagccacttaaataaaagctacttgaggtaataaagatatcttctgttttattctcttttttcccccacaagatttcttcatatgcatttcccactctgctcctctgcaactgagcaccaggtgtcctttatatcactcaggtaaccataaaacaacactttgaagccactcatttattcccacaaatggacagaaaaacacaagagaaactatgctagaatgtacaggttatgagaacctgtgtggttatttagcaaatgtcttcttcagtttccattcaaatcacttgggtctctatgatttccacaagactatgtcttggtctgttttctgttgctgtaacagaatgccatagactgggtaatttataaagaaatttatttagctcacagttctgaaggctgggaaatctaagatgccaaagccttactggcatctggtgagagccttcttgctgcattgtaacatggtggagggtatcacatggagagaggtcaaaagagtcagagagactttgcttttataacaaagccactcctgagataatgaacccacttccatgataacaacattaattcattcatgaggccagagctgacattaatccattcatgaaggtagagaaattaagtttccaacacacgaactttagggggtacattcaaacaatagcactgtccaaacattccactcttcattggaagtagagtttgaactaatagagttagtaatttggagagttggattatagtgtcagccatccgctcagaaactcagtttccccaaggtttaatacccactttttcaacatacacagtgattataaagacatcataagaaaatatgtgaatgttctttgaaaagttacaagttatacaaatgcaaattatcatttgtgatggctaattttgtgtgtcaaccagactaggcctagatatttggtcaaacattattctgggtgtgtctatgagggtatttctggatgagattaacatttgaggagctgcgtggcggctcacacctgtaatcccagtactttgggaggctgaggtgggaggattgcttgagctcaagagttgaagcccagcctgggcaaaatagtgagacccccatctctacaaataataataataataaaatagccaggcatggtggtgcgttcctgtaatctgaaatgagaggatcacttgagcccaggaagcagaggcttcagtgagccatgattgtgccacttcactccagcctgggcgacagagtgagaacctgtctcaaaaaagaaagcaacacaaaaaaaaccaaaactccattataatcaatatactgagtaaagcagattgtcctctctaatgtgggtggggatgggcctcatgaattagttgaaggcctgaatagaacaaaaaaggctgaccctccttctagtaactgggaactcctcctgcctgacattcttcaaactggctcttctttgagtcacgagcctgccagcctttggactggaactacactgttggttcttctgggtttcagtcattctgactcagactggaactacattatcatcttctctgggccttcaccttgccaactcatcctgcagatcttgggatgtgtctgtctccataatcatgtgggccgatttctaataatttctctctctctctctctctctcctctctctctcttcttttttttttttttttttttttttgagacggagtcttgctctgtcgcccaggctggagtgcagtggcaccatctctgctcactgcaagctccgtctcacgggttcaagcgattctcctgcctcagcctcccgagtagctgggactacaggcgcccaccaccacacccggctaattttttgtatttttagtagagacagggt[143 bp omitted]tgctccaaacttagagttcatttatgcaataaatatttattgaatgtttgttttaggtgctgtagatgaggtgctaaataagataaacaaggtctctgttctcatagagcttacattctaatggagaagaaagagaaaataaacaaaacagtaaatacagaagaaaatatccagcaatgatgaattatttgatgaaaatcaagcagagatatgtgatagtgattgaattgagtaaataggctaatttagattaagtgatcaggccttcctgaggtgatgacttttaaaggaagaactgaatggcagaaaagagccaaccatgggaagatatggggggaaagagaaaagagctgcagcaagactctatggttgtgttgaacttggtgtgttcaagaaatagaaacagagataggctagagcatagtgaataagaaattagtacaacatgatgtcacagacataggcagaaaccatatcatataaagcatgtagggcatgatagatttatgtgccagaagaagccattgataaattttaggtaaaagagtaccatgatctgatttatgtctttaaaacatcacttgagctgggcgtggtggtgctcacctgtagtcccagctactcagcagctgaggtgggaggatcacttgagtttaagactggcctggacagcacagcaagaccttttctgaaggaaggaaggaaggaaagaaagaaagagagagagaaagaaagaaagaaagaaagaaagaaagaaagaaagaaagaaagaaagaaagaaagaaagaaaagagagagagagagagagagagagggagggagggagggagggagggagggagggaggcaagcaggcaggccgggcgtggtggctcatgcctgtaatgccggcactttgggaggccaaaatgggcaggtcacctgaagtcagtagtttgagaccagcctgaccaatatggtgaaaccccgtctctactaaaaatagaaaaattagctgggcatggtggtgcacacctataattccagctatttgggaggctgaggcagtagaatcaattgaacccaggaagtgaaggttgcagtgagcagcgatcacaccactgtgctccagcctgggcaacaaagtgagactttgtcccaaaagaaaggaagaaagagagaaagagagaaagagaaagaaagaaaggaaggaaggaaggaagaaaggaaggaaggaaggaaggaaggaagaaagaaagaaagaaagaaagaaagagaaagaaagaaagaaagaaagaaagaaagatcactctggtcactgtatagagaataaggtgtgtgtgtgtgtatgtgtttgtattcatctggcaaagaaataatagaatacattttaataatagaataaccttaggcttggcctaaggtggtggtgattgagatggatggatttgggatatgttttggagctacagcaaatactacgtcttaagatattgcaggtgagtggtaaaagaataaaaacaattaaacatgaactttaggtttttgacttgagcaactaagaactgaagtgggaaacactgtcactggaggtgggaaagaatcaagagtaccgtttgggatatgttaaatttaagatgccatagaagtggagagctggatatacgtctggagttcttggaaaaagtcaggcctggagatgaaaataaaggcgtcaacatcattgacaatatttaaagccatgggactggataggattgctagagagagaggggatgaagagcaagagtccccgggcagagccttggtcattctaagacttaaagattaagcagaggggtaggatgcagcaaaggaaacttagaagagattggtgaaataggaagaaaaatccatcgagtggttccccagaagtctagagaggaaagtgtttcatgaaggggagtgtggtaaagcatcttgaatgttgctaaaaagcaaaggaaacacatagagaaatggacactagattttgcaacatatcagatctatgttcaaaagatcactctaataacagcatggagaaagggtttgggtgggcaggaggtggtggcaagaatggtaacaaggtgataacagttaaatgatcattgttaatgcaactacaagagaaagatcacaaggaccttgactgaggcagtgatagtgatggtggagaggaggagatacacacagaaaatcagtcaactaaattcaacttatatcacagtcaaaccttagaagacatcaaataatataaaagcaaaaagcctcatccaaaggacagcaacttcaaaaattaaaggaacattatcccacacagataagaaagaaccagtgcaagaaatctggcaactcaaaaagccagagtgtcttcttaactccaaacaatgcaacagctttccagcaatggttgttaaccagattgaaatggctggaatgacagaaataaaattcagaatgtgtatggcgttaaagatcattgagattcaggagaaagttgaaacccagtccaaggaaactaaggaattcagtaaaatgatacaagagctgaaaggtgaaatcacctctttaagaaagaactaaaccaatctgatagagttgaaaaactcactataagaatctcgtaatacaatcagaaatattagcagcagaatagactaagctgaagaaagaatctcagagcttgaatacaggttcttcaaatcaactagtcagacaaaaacaaaaagaatgaaaaagaatgaataaaacttttgagaaatgtgggattacgtacagaccaaacctatggctcattggcatccctgaaagagagggagagagagtaagcaacttgggaaacatatttgaggatattgtccaagaaaaatttcccaacctccctagagaggatttttgcctgaacaaaactgataccaaaacctggcagagacataatgaaaaaagaaaacttcaggacatttgctcatgtaacaaacctgcacatgtaacccctgaacctaaaataaaagctgaaaaaaaaaaacaatgtggtaacagagcaaagatagacaaatagtccaatgaaacaatagagaatccaagaaataaccacacgtatatgaaacttgataaatgaaataaaaggaatggcaaatgttaaaaaagaaagaaagtagattcgtagtttcctagggctgggggtagggggagatggtggtagggcaggtaaaggataatgggtattgatggctaatgcctgtaat[132 bp omitted]tgaaaccctgtctctactaaaatacaaaaattagctggatatggtggtgtgcacctctaatcccagctactcaggaggctgaggcaggaaaatcacttgaacctgaaaggcagaggttgtagtgagctgagatcacgccactacactccagcctgggtgacagagcgagactccctctcaaaaaaaagaaaaagaaaaattagattttgcacttttttttttttttgagatggagtcttgctctgtcacccaggatggagtgcagtggcgcgatctcggctcactgcaaactccgcctcccaggttcacgccattctcctgcctcagcctcccgagtagttgggactacaggcgcccgccacc[182 bp omitted]atttctctcaacaatgttttgtagttttcagtataaaattagattgtggtgaagaatgtacaactctgtgactatactataaaacattgacttgtccacttacaataggtgacttgtatgatatgtgaattatatgtcaataaagatgtcaaaaaataaaaaaggccttcatacctcctcctgcttgccttgtctctcacctctgttctacctatattgtggccttcagccatatctcagtaaattccattccccaattagcatccatacttttctgcctctgtgcatttgtttgacctcaactaattccctcttatttcttcctgtggaaatctcatccatcctccaagactcatttccattcctttgtcactgaccagatattctaacttgtattgtagttattggttgttgtcttatgcccataattaagctggaatcccttgaggtcacagttcatgtctgttttgctacattcctgcagaacctagttcagcaataattaggaactgaaatgaattcaccttgaactaagagtgctccacaataagattttcctttagctcttttaaaactttgaaatactatgatttttagttatttagcctcaacagtttttatagccatctctgaattcctgctgagtttttagccctttgttagccatatggtcatggaatgctgagagttcttatccttcactactctttaattcgatatatgtatgacatgaaatatatgtatacatgcacatatggtacatatatacataaatatataaagataaatataaacacatacatattgagagagagagaatatattatatgccagatactgggaagatatcaagacataaaagtcataaagagttaagagttcatagtctttgcaggtggaaatgaaggtgggcatatacagacataataaaacttctagatttagaagtgcacagaggaaatagcactatcttgcagtgagggactactgagtgccagtgctgttctcctcaacctacctcaactctgcaaagtatctaagtctttttaactgcccgagtgtcatttgaggccatgtctaatttacagattggcttgcttaattttcaaccatattgcttttcaagtgtcttatttttttttcttattatgtattaacttgtccttaaacagattttgtttattgacctattttagaatttttgttgtcccttttctaaaatttgaaaactaatatgttgaagcctgtaatttctcaatgtaaaagatatctagccatttaatcaagttttaccacatttcatcaataactcaaagaaatagacaatatccattttattatcactggcttcatctaatcaggcttaagaatgctttcaccaatgggtgaatatgggccacagatgctcttaggagtaaagtgaaccaaaacactgatttcctaattcaagagttatccaacacttttaatagtcacatttaattactttcttaaagctacaataaataaaaattttaaaaaataataaaatagtttgaagtaaccacagctttccttatattcctgcaattcttcttcttcttcttttttttttttttttttttttttggtttacttggtgtcaacataagtgtctgggaaaagaactcaagtgaagaacctcagtcaaaagacatacatcccatccttgtgccaggtggaaagccaacctctgaaatgccaaagggatcggtcttctgattaatggagggtttgatagaatgtatagtttattacatttttggcccttaaaatttttacccaaaatgggtgaatccactttcatgcctgagtcctaacactaatgctcttagaagaggaggtcctcagggtcatcattctgggccgtcttcatccggaaccaaaaatggctcctgagattggatttactgtctcctgagtccaaatagtcctagatttgatttcaaaacatcccatcagcctcttcatattctcccagcctgtggcttgccttttcattcacttaatagaatcttttgaagagcagtttttaatagtaatgaagtcaaacatatcaattttttctttcacggattagccttttggtgttatatctaaaaatacattgccaaactccaaatcataaagttttctcctacgttttcttctggaccttttgtagttttgcattttccatttagctctatgattcattttgggttaattttgtgtaaggtgcaaagcgtgtgttgagattctctttttgtatatggatgcccaattgtttcagcaccatttattaaaacacccaattaatttttgtagagtgactggattaattttgaaattgctggtcttggttatacattgtgctcctgttttctttacatgaatggtaaaaattttgaagttcttaatcattgcaagatggcctcagcgggtttcttgggtgacgagccagtacattgtgatccataaaatctttttggaatataaatactgatatttatatactatattattttatatttatatttgttggatattcagcttgttgaagtaacaagagaaaattatttatatttgttaacaagagaaaattatttatatttgttggatattcagcttgctgaaataacaagagaaaattaggtgacattttaagaagaatttaagacctagtgattggaagacttggaagcttgtgtcaatccaggaaatatcacttattttaagaaacctgagtgtccctcacacctaaatgaattccaaatgggtcaaggattttacaacaaaatcatgaagaaatagaagaaaacacaggataatttttatatttaattttgcagttgagaaggcctttttaagtatgacagaaatccagaagccataaaaggaaacattgataaatttgaactcatataagtaaaacaacttctgcatttcgaaatacactataaacaaagaacaatgtaaaaaataaaaatgacagactgggaataatacttgttacatgtatcacagacaaaaggataattttcttattatacataaagaactcctacaaattgacacaacaacaacaacaaaagccatcaattcaattcaagtttgcaaaggaataaataaaaagttcataggaaatataagagctgcatcagctcatgaaaagatgcccatcaatagtagtaacaaaagaaatgcaaaataaaaccacacccagataccatttttacctgttatgttggcaaagacacaaagtttaattacaccttgtgtgatccaaggtgtgggaaaataagtaccctcatgcattgctggcaagagtgtaaactgacaatactatcaagctggagagtgatttggcaatgtctattaaaatcaaaaatgcacttacccttctcacacacacacatacatcaatattcactcattgcatcattattcataatagcaaaaaattgaaaactatgtccttcaattaagactgattctacaaaatacgatacatacatacaatagaatactatgcagcctttaaaaaatgagacagctctctgtagtttgatactgaaggatctccaagatgtagtgttaagggaaaaacaaagcacacaacagtgtctagtatgcaacatttctaagaaaaacatgttatagactgtgtaagtgtggaacgtctcttaatgcacacaaggaaatcagtaaccttgtttgtctcaggaggatggtttaagggagaagcaggaggaagtcttgcttttcactgattgtctttctgtgcatgtattaatattttaaaaataagataatttttaaaactgaagtgatagttttcaatgtcgttttagaagccccttaggttcttaccctcaggatgccaacgccaaagatctggctcctcaagtagtgccccacaggctggttaatagctccacagagggagattttagaacttggtgctcttttctatatatatatccagcctgtgatggactcttaaataagaaaggtccaacagtgcacattgttgtttctgtggttagctcatacttagcatgacactggaaaaacatccatgggaatgggagtggaagcttcaaatgcacttttcagatctatgtgagaaatttctgagtgtgaatacctttctcaaattaataggttaagtgtttcatgtgttcatatgtttatatacatataaaaataaacctacaaaaaacacacaaaagggttaacaacaacaacttctggatgatgggatcataagctgtttttcttttttttttttaatttttgtaattttttttgttttttgtttttttgtttttttgagacagggtcttactctgtcacccaggttggagtgcagtggcatgatctcggctcactgcaatctcaacctcccaggcacaagtgttcctcccatctcagcctcccaagtagctggggttacaggcacgtgccaccacatctggctaatttttgtattttttttagagatacggtctccccatgttgtccaggctggtctcaaactcctgggctgaagcgatctgcccacctcggcctctcaaaatgctgggattacagacatgagccacagtggccggccatacactaattttctttgtattatttaatcatgtgcagttttaaattttctacattgaacatggattgattgtgtaattaaagaaaatctctcttcctttgagcattattgtccataaaatattaccttgtctaatttatgctctacgtcattaaaaatgagcaatcaagaaatccctattgtgttaacgtactaagaaaaagatgagtgtgacagaagaatggtacaagacccctctgttcaggcataaatcttattctaaggtcatctactttctgttcatggaagaaggagcatggcctgctcactggttaaaggtgaccctggtatattaagatgagaaaaactggtgagcaagccaggaaaagcaagtgcacatctcagaagagtcagggccaggcctgagaaaactatgaagtaggcccacaagtgaccccagctctgtatgattccattttgctcttctatagcatccccatttctggcccctttcaagagggtggaagtgagaagatggaaaaagtgaaggtgttactgggaagtgcaggaatccttggttcttgtctaatttgggagaaagaatttgtccaagggacaattagtaatgcaagccaaaggtttattaaagagataagagtacaacccaagagaggagccagttaacttggctgcaaaacagctctgggctggtctggctggaaagcagcagcagcagcaaggtttatttaaacagacagtacactctgaagcacgagtcagagcaggctgctcaaaagaatgggctagcagcagctggtgctgggggactctaagagaatcttacttgattattcatgaaggggcataacggggtgtcacttgcaatcatgttttaggtggtacccttgggtacacatgctggatgatggtacatgttagcatgcatgacacatgtatcattagtatttaaaatccccactcaagggtctgttttttactattataatgagcaaaagggtactctagggcaagctattggaggagtgtgcatgcacatctgcctgggaagtccctatcatggttatctccaactagggcctgataagtctccttcagggctggaggagcccaaccacaaggccagaagtagccagtgtagcccatcttttttgctgtcagtgggcagcgtctctgcgacttcttttcccaggggctcctttgcctgttcgttcctggttatctgcctactctaacaaagggactttgtggagggttaggaatggaggtaaagtgacagaagactctcttgcctggcatgaataaggggtttgccgcagctttatctctcacatgtagaagtggcttctaagggtaagcatgagacacaggagccaaacagggaggacaatggagagaaattccaaatccattgctcaaataagctttgttagaggcaggcagatggaaatcctgcagctctgtattccatgacatgaatagtttattgtaaagattaaaatattcctaatgactgaggcaaaatgccggttggatttgtcaagttgtatgacaagcttgcttctgtttctggaaaaaaaaaattgtcacagaagctgactgagctgtggccaaaaagagataaagtgtaataatttacccctcagccattacttcttgttttaaatttcttggtgggaaaaaattcattatgtccgctatgaagaagagaacaatcctggagggcttctatttttcaaaaggcttgagaattcttcaaatgaaactgcagcacctatacgttcataaacttcaagtagttttaacataacattgtctttgttatcatgtcaatcttagctcaccaaatctagaagcacttgctgtgtaactttcccgtgttaatgatcctaacaggtttttcagtacttctaaggctattaggtctctactgctcagcgcttcacttggaaagaaagtatggatttgatggagtaggaaagatacacgttgccaagttacagtttcccatctagattgtgtcacccagagcaactcatcaagggacaagattatgggagaaaaagaaaacatgggaaacaatgttaagtaattgaaaaagttccatagccagagactggagtccttcagtactggtttccattattaactcgttcgacgagatgaagataatgggactgaacattttactaagaacactgtaagtatttcaaaagcgtctaaaatcatggcacacagacagtctccatattgttattctctatgttagtgagtgggttgctcctgagcaagtagaaatttaaatttaaagtttctgagataattggcacaggagtatgaatttgagtttgttattgtgggtctgtgattcattcataattaaagaaatatgatcatctgtaaaatgtggctaaaaaaagaaaaaagaaatattttattaaattttagaaaaaatgttgccagcatgtttttcattgaaaagataatgtatcaaaaagctaaaaacattttctaaaagaaaatatggccgggtggcgtggctcaagcctgtaatcccaacactttgggaggtcgaggtgggtggatcacctgaggtcaggagtttgagaccagcctggccagcatgatgaaaccccatctctactaaaaatacaaaaattagctgggtgtggtggcagtagcctgtaatcccagctactcgggagacttaggcaagagaattgcttgaaaccaggaggcagaagttgcagtgagttgagatcatgccactgcactccagcctgggtgacagagcaagactccgtctcaaaaaaaaaaaaaaaaaaaaagaaacaaaatatgtttaatagttgtaatcagagtcaacttgctttaaaattttaaaatctaatacagttcaaattgagtatttttgcttattaaacacagaaatgccaattcatatacagaattattcttttagttttactgtttgtttatttacttatttatttcatttgaatcagggtttcactctgttgcccaggctggagtgcagtggcccgatcgtagctcactgcaaccttgaactcctgggctcaggtgatcctcctgcctcagcctcccgagtagctgggactagagccatgcaccaccctgcccagctaactttttttttttttttttttttttggcagagatgaggtcttgctatgttacccaggctggtttggaactcctggcctcaagctatcctttcgtgttgacctcccaaattgtgaggattataagtttgagccaccacacccagcctcagtttcacagtttaattatttctgaaactgtggttcaaatatttgaaattattatttttaaaagattgggtaagagtttaacttttgttttacaagggatatatatgtatatatacatatttggtttggagacagggtctcactctgtcacccaggcttgagtaaagtggcatgatcacagctcactgcagctttaacctcccaggctcagatgaccctcctgtctcagcctcctgaataactgggaacacaggcatgcgccacaatgcctggttaattaaaaatatatatgtatttgtagagacagggtctcactatgttgcccaggctgctctcaaacttctgggctcaagtgatcctccagcctcagcctcccaaaatgttgggattacagggatgagctactgtgcctggtctacaagggatattttaataggtatatttaagaaaaagacttggacatttagtatgtaagcattatccttcaatgtagagtagttataaaaaataaaactaaaatatttctatgcaggaacaccttgtcaacagtcatttcataactactttttattttctgcagcatatattattttggtgctagtaacattgatgagatgtgactgtgataagcatgaagaaaaaacaaatgggacaatattagaaactgaaaaccaaacgaaaacactactactggtattgtattgaaaacaaatcacatgaaataaaataaattgaatagccaaacttaagatctacatgcataaaaagagaaataaattaacattatttttataacaaaagaaatgaaatctataaaatatgcaaatagctttatcttttaggttcaataaacacttatttatacttcctatatgatatgcttttccacatacattatattgtgtttccttgataacatttttactgattttaaaaagtagactgggcacagtggctcgtgcctgtaattccagcactttgggaggctgaggcaggaggattgcctgaggccaggagttcaagaccagcctgggaaacatagtgagacccccatctccacaaaaaattaaaaaatcagttaagtgtagtggcgtgcctctgtagtcctagctactcatgaggctgaagtgggaggatcacttgagcccaggaggtggaggttgcagtgatctgagatggtgccactgcactccagcctgggcaacagagcaagaccctgtctttaaaaaaagcaatgtatgtgcatgcatggagtcaagatatatatgggaactctctgtactttctgctcaatttttcggtgaacctaaaacttctctaaaaaataaactctattaaaaaaggcaatatatacttattgtagaaaattaaatttacaaaggtataaagaagaaacttaacataacccacaatcttaccacccagagaccactattgccttttctcttttagttttttctgtgcatatatatttataaccatttaaaaaataaaataataatcatgctgcagatgtaaagtaatttaagcatcctatacctacagaaatagcaaaatgttaacaccagaaattaatgtgcctttcagcaataaaaaaaagaatatattttgttaaccgtatggtcaaataaaaatttattttcacaattggtggacacgcaaagcagttgaaatagtctgaaaaaaaacttggacatatataattaaagtgacaaacacatctcttttttctctctctcatcaggatctaagccaagaaactaaaaataaaaacatgaatcaagaatgatcccaacaaccatgctggaaactaaatatttcatttttgtttcactaaagatgtgtcattagtgtaactaaggaaaattatactctaattggaaacacaacatgaaaaattatactgtattgaatcctgcacacaataaattgaaaaatgaaaccatgaaaaaatgcacagaaaaaagcaaatgcgacattatacataaaaataagaatatgacacactgaaaactataaagtattgatgaaattgaagaagacataaataaataaaaagatatcctgtgttcataggttggaagaattaatattattaaaaagtacagactacccaaagaaatctacagctttaatgcaatccttgtcaaaattcaagtgacaagggtcacagaaatggaaaaaaaatcctaaaatttgtatggaacctcaaaataccccaaatagccaaagcaatcttgaccaaaagcaacaaagctggaagcatcacactacttgatttcaaaatatactacaaactacagtaatcaaaacagcatagtactggcataaaaatagacatttagacaaacggaacagaatagatagcccccagataagtcaacacatttatagtcaattgatctttgaaaaagtgccaagagcacacaatgaggaaaggacagtttcttcaataaagtgcactggaaaactggatatccacatgtctcctttgaaaaagaatgaaattacaccgttttctcacaccatatacaaaaataaaagagattaaagactgaaatgtaagacctgaaatttaaaactactagaagaaaacataggggaaataacttcttgacatcagtcagggcaatgatttttggactatgacttccaaatcataggcaacaaaagcaaaaatagatgattgggattgcatcaaactaaaaaacttctgcacagccaaggaaacaatcaacagagtgaaaagacaacctacagagtggaaaaaaaaatttgcaagccatgcatctgataaggggttaatatccaaaatatataaggaactcaaacactcaatggtaagaaaacaaataactcaataaaaaatgagcaagggacctaatagacatttctgaaaagaagacaccaatatggccaacaagtatataaaaaaatgctcaacaggcttaatcatcagggaaatacaaattaacactacaatgagatcacttcacacgtgttagaatggctattatcagaaatatgaaagaaaagtgctggcgaggatctgaagagaaaggaacccttgtctattgtttgtgggaatgtaaattggtacagccattggggaaaacagtgtagagtttccttaaaaaattaaaaatagaactaccatatgatctagcaatctcacttttgggtatatattcaaaagaaatgaaatcagtatgtcaaagagatatctgcaatcccgtgttcgtcacagcattattcacaatagctaagatgtgaaattaacctgtgtccattgatgaatgaatggataaagcaaatgtggtatatatacacaatggaatactattcagccttaagaaagaatgagatcctgtcatttgtgataatgtggatgaacctggaggacattatgctaaatgaaagaagccagacaggtacagaaagaccaatactgcatggtctcacttatatgtgaaacccaaaaaagttgaactcatagaggcagagagtagaatgatggtggccaggggctgggagtgagggcagtggaaatatgttggtaaaaaggaacaaagtttcagttatgtaggatgaataaattctggaaatctactgtacagcatggtgactacagttacagtattgtatacttgaaaatgctaagagactaaatcttaagtattcttaccaccacaaaataataagtgagttgatgggtacgttagttagcttgatttaatcgtttcacaatatgtatatatatatatatatattacaacatcatgttgtatactgaaaatatatacaattattttatttgtcaattataccttaataaagctgaggaataagtgagtatataactatgtacctatcagaatggctaaaataagaaataatgataacaatgcatgctggtgaggatgaatatttggcacttgtgaaaggtgggggtttgctaatggtgatagttcaggaattttccctggagactcttcaaatcagaggtagcaggcctttatacacatgtaattctatgatttttccatatgtgggaaaatttatatttggctaaatgtgcagccagctgcttggcaacatttcccaggagagctgggattgcagtaaaaagtgaccatttctggcactgtttttggaacaccctagattggcttcaatggtttcaaaggaacatttttgcacaatttcctcaaaattaattatcccaattcattttataccaaagataatttaaggcaggaaatgccccctgaaaatccttctatctaaattgtattttatccccagttcttcctccacaaaaccgtcttagactcacttggcccacagtgagctcttcctgtgagaattcctcctgtatttatgatacaagttcaggtggcctttcagaggccatgtaatttagcacattcttctgggtctatgttcttgctccgtttgtcagcgattggctctctccccaatcaggctgtctactccttgagaataaggttggtgtcagataaccttagtcatactcctcccccagccctctcagtgggttagcatagtttagaaccaaacgtgtgttcaaaaacatgcaattgagaatgggcgtggggatgacataaagtctgtgtccctgtaaagcgcttaaaaaatggcttcaagagctccttgcacaaacaccaattgcaattttctcctggatgctaaaaccatgtgtacattatgttgggctctgtatttaaccagcctgaagtctagacttatcttccctgggccctcagccagagattacagagaaaaagcagccttgggtgaatgtcttgtttggaagcggaaagaccttgttcaagtgttggtgtaggaacagcagcagacaggagctgagctacctccctaccacccctcactggggagtgatcagtaaaaaaggaaatttctatgcacagtagattgtgagattgtgctctattggcagctgctgagtagtagtgctgagatagaaaccaaggcaggttggatccacaagctgtgctctcaaccactaggttacactgtctctgacgatggtcccctgttaatgaacatacttgctgtttctggttttcaaacatttgcagtactcttccttcgttcattgagcagggactctctctctctcttcttatctgtcctatctatcttttatctgtctatctatctacctatctatctatctatctatctatctatctgtctttttttttttgagatgtagtcttgctctgttgcccaggctggagtgcaatggtgcgatctctactcactgcaaactccacctcccgagttcaagcaattctcctgccccagcctctcgagtagctggtatcacaggcgcgcatcaccacacctggctagttttgtatttttcagtagagacagggttttaccatgttggccaggctggtctcgaactcctgacctcgggtgatccacctgcttcggcctcccaaagttctgggattacaggcatgaatcactgctcccagcatttttctttcttttatctgtctatcgtgttccctgttatatccccggtgcctgacaatggttgctaaggaaaagttgctgaaagaagtccctcttgtatccctacagtgctctgtgattgcctctgtcattttacttaccatgctgtgttgtatgaggtggggctgcacttatttcagacatttctttgtttcatggaattttttaaatgaaccctagtaggagggatgcatccatacccctcaatcattttagtgatattgtcaatgtcttttggccaaagatcactaggcacacacatgttgatcaacctgggtttattacttgttgaagtgagggggcatgtacaccgtgaagaactgtgaggcatctcaagaacagtatgttagaaaagatttgttataggatttgggcattggctagatgactgggggaaggtcaaaaaaagctatggtttgccctatattggatgctgtcagacagtagaacaattctgtgatcaagtatttcaataagttttagctagagggagggtagagtagagggaagctacagctctagttagtaaagagtagcagtcattcattttagctgggagagggatgttttgtcatttctgtggtttggacagtgttcacattttgtctggtttcagccattacagagttatcttgcttctgccttgatccatcatagtcacagagttgccttgtctgatattggcattctgtggatttatgttcaacagaacaacaagacctagtttggtgttgctgctagtgctaggccagctcctagcaacagcaaggcctagctgatggtactagtccaactcctggatggtaggagatgcttttctctttctcatatgagtattttaccagaagggcatgtgcagggagctaccttaagtgcatttcaaataggctcctgaatacctccatccatcccacaggtgttctacctccaaagccctgttctctgaccccactgcattgctctgtttccatctatccaacccctgctctatttctgggccaagtcctacctcttctacgaagacatctctgaccactccacaccaaaatactttctcactactctgatctcggtgcctttactgtttgatctgtttctttgacattttctggttatatcaagactctccggctcactaccatatcctaaggcctaacactacatatggtctagtgaagcggtagcatgtactgctatttaacctttaatgcataggttttgtccccccagctgaactccaagctactcgagggcaggaattatatgctgaggacccatatgttgcttatgtgccaggctttgttctaagattttacatatattagttcatttaacactcacaacaagcctatgtgataagtgctcttattatctacatttttcgtattttaaaaaacccactgaagttcagggaggctaaataactacccaagatcacgcaggtactaagtggcagagcttgggttaaaatccaggcagttcagcccccgagtttgacaaattctttgttttatattcacagcagggacatctggaattaaaacgtaccatcctctggagaaagtcatccttattcattttttccctggacctgaggtgcctctcaaggagttggagaaatcagaatctccctaatagagatgagctcaagggtaaaaaaaaaaaaatgtgatggataagatctaagcttactacacagataaatgactgcatattacccgcataccaaagcactttttcctttacaaaacccttgcctgcaaattccttcaaagagaaagcaccctaatgcatttcaaataagctctctgtatgcaacatttcccttttcagccctcccgcatctctccccacccgctccaactgtcagtggagtggcttgagtgggaactgctataggtttttagaacttatggtagtgaatgtgtgtccttttaacttccagaagactctggaggtcagtgggctggtgaggcaacctgttgccaaacagtgccaaatggtcatttgaagctaaaccagcccagaggatgagctgtgggctgtactgcaaagggagttgtttggttgttggcatggggcttcctgaactagacctgtcaaagagcccatggagctatcttgaaatgttctttagttacagtcctttacagtagctccttcaattgccccatcgatagccctgccatgagaaacaagaaccccttctgcaagccatttggaatatagaggaaggggaaatcattatctatctatctatctatctatctatctatctatctatctatctatctggccaagagtggcctgatttttgttctcatttctttgaactgaggtccactccgttataaccttgctttgttctttcccagtcctagactgccatagatagtgggcttgcagctttgtatggaggcattcattgggcaccagtgcactgacagtctctgaagaattattaggtcagctggttccaaagcatttcaggctgattaaggccctggaagaatctttttcctagccccttctgttacctcttccgtgccttcccctccagttcactcagaggctggttcatgaccagttgcaaaaagcagggtagtagcgcatacgaatcttctctctaaatcctcttcagatgtatttcacttataatacgtgttcttgaaaatatgcattaataaaattgtgtttgcttgaatagagaagctaccatcactgtgtggattagaatggcattggtgtaaaaatctatgaagataatacatgccaagttagatcaatgcagtttggtaggtggtatctccttagatcctcacaatgccacccttatcctccggttacaagtaaggaaactgaggaagagtgattcccagaaaaagaagaggaagacaagataaagaggtaaaagataagagaagaaaagtacgggaagttttgggcagaaggtaagaggatattggtagagctttgtgggggtgggttaggagaggtgaggggaagcttttaggtaaggacagatgtccttattgtgaatctggaagggcacagaaaagaaaccaaaacttaaacatttctggaggcactgcctgggccaccctcctggaatgagaagatctgaggtcagagtagctaaaaaaaaaaaaaaaaaaaaatccttctataaattatgccttctcttggagcgaagtgcgacctctactctgaaacagagtcatacagcaccactcagtggcagtctctcggtagtgcaccgagagtgtctgcagcagccacccggacccaatgaatcagaaccttgaaagacagaggagaggcggttatgttattttatttaatccccacgaggttttgatgtgatgccacatttgagaatttcaggccaaacttgtgctttctctatgatatgaagactttttaatttaatccccatgagattctgatgtgctgccacatttgagaatttctggccacacttgtggtttctctatgacatgaaggctttttctgatgccaatcagtgtggcaggaggcacctgggcaaagcagaacctagaccctctctttgctctttgcattctcttctcaggagtttccttctttctcatcaactatcacttctcagtgcatgattatgtattaggtgctgtggtgatatagcatggcacaagacaaacaagatgtctgttctcatggagcttacagggagaaagacagcaaatctatacttacagatggtgataggttctatgaaggtagtagacagatatggcagtgagacagaaaataactgaggtcagagaaggcctctttgaggagttgacattgaagccaagacttgaaggttgagaagaagccagccatgggaagagtagaagcaaggtcttgcacaccaaggagcacagcttggcaagaggactgcaggctagatttcggcccaccctacacctcagctggatacctttgtgtagagaacaatctgcacgatcttacatgagagtagggggtaaggggattgttccagcagatggaatttcatgtgtaggcaagaacatgtattctagaaattatgagaacagtgccaggaaaagactagatcacaaagggtcttatggggtaagataaggagtttgtatcttatttaattcacaagaagccagtgaaggtttttaaacaggatgactgaaagatatgaattatattctttaaaaaactctctagttgtgcagagaatccactggaaggggaaaaaccagttaggaggctattgagtagtcaaatcagaaatgctaaaggtttgcattagaatgagagtattaatagttgaagagatgagaagtggacagatttgagagacgtttaggaggtaagccgacagatggaatggatgtagaaaagaattaaagagggcaaccaggtttccgatgaaagcatcttggtgggtagaagtgccatttcctaagaggaaagaacaagcagagaggaggagcaaatccagaatgacattttagctacttcaagttggagagatctgtgagatactcaagtggagatgccaagtcaaatttgttataaacttggaagaggggtttgagacacagatatcaatttggaaattataatcattgggttatcttcaaggccttgaaacaaagattagatcactgagggaagggagtatagaaaggcaaagtcccagaacagagcccagagaaactctagtttgggggaatgaggtaaagagtggccaaagaggagaaaactcagaaaactgtaatgccacagaaatcctgaaaggggctgtttaaggaagagtaatgtgggtagctgctgctgaaggatcaagaaaactgagaatagaaagagactgatggctttgaccacatggtggtcattgcagaccatagtcggagcaagggcaccaaactggaaaaataagaagtggtggtcagagtgtggaattcttaagattttttaatcttgagattttgggagtgatgtatattttcattaagaaaggtctaggatccttggcatggtcctgagagtaagtggatgaggtagggtagatggcaaattattggaaatgtagaagctgagaaacagaaacgtttgtgtgttcaatggcaaaattgtcaaagatttagggtggagggaaagtgtagtgaaactgtggttgccaagcagtcttgagcgtgctcatgaccacaaatttttagtgaatttagtcaaccaactttcaatatttttatctgcttcatttagtggcaaggaaaaagtaatatagtgcaattcaactagagtttggggttttgcctagtagatatgatagacagctaagaggagaaagggaatggagtgagtgagtaggtatcagtttcctattgctgctgtaacaaatcaccacaaactttgtggcttaaaatacagacttaaaatattagagttgcagaggtcagaagtgtcattgagctgaaatcaaggtgtgggcagagctgtattccttctggagactctagaggagaatctgtttctttgacttttccagcttctacagcctgcccactttcactggcttatagtttccttcctccatctttaaagccagcaacatcaggccaagtctttctcatgctgccatctctttggttctctcttctaattccctctcccacttttaaggatgcttgtgactgcattgggcctatctgactaatccagaataatctccctatcctaaagtcaactgattagcaacactaactccatctgcaaccttaattcccctctgccaggtaacctaacagacccacagggttctggggattaggacatgggcatctttggggaggccagcattctgcctgtgataatagcaacacataatggatggaatttaaactgggtaagtaggcaaatgaagaagatggtaggaaggtagagtgaaaaagtggctaggtcagcagattggggaaataatctgatgggattgaaacattgtagcagtagagaagaaattttctaaatggtgccatttctggtaatggaaaaggctagtgtaggaccatgggggtaagtatctgatgtaagtttgtagaaaagatcagatgaggaggtcacggaagtggaattccaggtcatgggataagtcatccctgtggatgttaaagtcacgaagaatgatgaacaaacttcagtgtaggaaagaagactgatgatgcaagaaaggcataaaccccacaagctagataagcctgtaagtgaaaaggagcctgtggtggtgcagacttgcccagaatcagaaggatggagccctgacatgcaactccactcccaggggctgagctcaaagttacagagtctgtgcaatgacccccttgggatgtggaagtcaaagtcaaatcccaagagagaccagcattccagactgtccctcgcccctcccgtggcttccatgagaagcaggaagtgctgggcttgaggaccgtgggctctacctggcctggaaggagatggcactcctgtgccagagtaggcacaaagtaggcacccgcagcctactctggctgtgacacagtagactaggaggcaagcaagggaccaagtcactccctgtatgtcaagggtgggggaagggtctcccatgaggggtgagatccctcattgtccccagcctcacagcagaatcacactaggttgcaagagcagaaatctcacaagaggccagggagacgatcccaagagagaaaggaagaggggatagcaaggccctttgcagacagtcaagccctaggcagatagaagagaaaaacaccattcatggtgatagtgattccaaagccgtttgattcatttagcaaacatttatcaaacaccgacctggtgcagagccctgtggcaggcaccgtgggtgttaacaaacttgagacaggcctggacattcaccctaaagggcctgtgctttcttggaggagctaaaccatgtccacacataccactgtcattaaggatagtgtctggtgagggtggtggggtacagatatagaaaagtaggctgcctggaggcggtgagttttgagccaggctgtaaaggagatctttgggctggtcttccaggggtgttccctgtcatcccaacattaagtggaaacctctgagggttgttgtggctttaggtctctcccactggcccaccttgaccttgatggtgggtctgcaaatggaaaggacttggccacttctgttgactgacagagggaggtggggtggggaaagagagcacctttccctaagaaaatctgaaatcctgggttgtgccaactacctggcttggcaaagatcagatgtcatgggtgggatagctggagataaaggaaaggtagcaactacacaccagagataagggaatgtgacatcctggatgggtctacatctgcagacaacaggctcaggcagataaccaaggctatggagattgttccacggacttctggctcacatacttgccatgaagagagccccaatgcgggagctaggaggacactctccctcagtttcacttcaggtagtttcacttcacttattgaaagcacatctgctcagctttttcctttctcttctgtttgctggtgctaactagtttcccctcccagggacttgaaaacaactggtaagatagcttactgccactgcaacagaaccatctcctccaggatctgcctcactccttgacaacaacttgctccataacaagcccagtgcccagttctatctccctgcagaaagaagcagctactgctgtgtactttttgccctagagactacaagattgacagcagtcatcacattgtgtttcacactcactgataagtggacaaggcaactaaagaggaaatgatttagtataaactggagtctctgcaaatataggaacgttgacactctatgcagctgggaaagctcagcttccagaggtcttagctaacctccaccccaaagaggggcacaggaacgatgggggaagaggcactaggatgtaaaccatgagcagtctgtcatctttggatttcatcagtcaaacaagcaagaggtacaaatgacagttgtaaggaggcatggcattggtacatgtaacgcactcaataaatttggtaaatgaataaataaatggtttaatgaataaggttgatcattttaggtaggaggtgaagaagatcagag[145 bp omitted]cccatctctactaaaaatacaaaaaaattagccgggcatggtggcgggcgcctgtagtcccagctactcaagaggctgaggcaggagaatggtgtgaacccgggaggtggagcttgcaatgagccgagatcatgccactgcactccagcctgggcgacaaagtgagactctgtctcaaaaaaaacaaaatggtggtacaaagaggagtatgtgtcctatggaaggcaggaaacctacttagtgatagtaattacataatagtcttgatattgcttctggaccttgcagaacctaaaatgtttcgtctctgccctttacagaagaagtttcaccaatccagggtgcctccacattggatcactatagtgctgctaataatcgtaaaattaaaaggacaggacttgtgtggacctaaaggctagccctggacactaaggcctcaaagaaaagatagagttctggattctgagttgtcctagagcttaagggccttgatattcattggatgcagagcatgtcaatctgatgttttcagcaaatgagcttagagctcactgagagcccctccttgacccttcctgtcccgccccctgtcacttaccaacccgaatctttcccgccttgtctaagtcctctcaggccaacctcagcgggaggctcctgggatcggctccctgcccttcccaccttagggtgtcctcagagacagacttttattccctcagtaaggagacagactcttattctctcagcagcccagcccctcacctcccctcagccacagccacatcagtggccaccgtcttcaccgttgtcacctcagcctagtcgccactccagttgaggcactgactggcgtcatgtctgccacaggggatcaagacctgatccaagaggaccaggaggctccagtgaaccaggagggagcgcaggccgaggccgtaggtgaccgggagggcggtgactctggccccgacagtggcaacactgtggccggagtcgcagggcccatgagaggcctcggggaggaggagggtgagcaggcggcaggcttggccgcagcccccgggggtgggaacgccgaggaagactcagagatcaggatagtagtggagatggtggaggaggaggaggatgaggaggaggaagaggaggaggaggaggaagagaggaacgaggcggacaacttcgacttggtcgcggccgcccgtcgctaccccataagaggctttcgcatggagtttctggacatggtccactcccttctcctccgcatctatcacaacgaccacatcctgatcaggatgcgtggcggccgcctgatgcggaggcgccgcactgcggcgcccagtggctcagaagagccccggctgttgctggtgcatgagaggctgggcgtgggggccgcgggtcctgagggcgagggcctgggcctgctccaggaggccgcgttggtcccagagcctgaggtgccagcagacctggccgagatggccagggagcctgcagaagagcccgcagaggaggcctcagagaagcccacagaggaggccgcagaagagcccgcagaggaggcctcagagaagcccacagaggaggccgcagaggaggagctcgcagaggaggccgcagaggaaccggccaaagaggaaccggctgcagaggaggagtccgcagaggaaccggccacagaggaggctgctgcccctgagggtgaggaacaggctatctgcagtggcggggagacagggacccgtgcacccaagggttccaggcagggccgcggtgtgcgcacagctggtgaagcaggtggtgaagtgggggtcgggcctcgggtggtgaagtgggggtcagggccctcctgaaacttaaggccaaatgtgtaccaatgagtcgaagcccaattctctaacgacatctatgatttttgagaaaacatgccgccctctaccaacctgtgtttgatagaagatctgagatcatcaatgccatttggggggcccacagatgaatggccaggtagataggggttcaggagggagctcggcaggaaacaagggacaacggaaagaaaagaacaggcaaatggcaggcatccttttttgttcatggcttttcaaagtgtaaagattcttagaaagttgatccccaaatgatgaagtgatacaggggcccttggtaaaaatgaaacattcaggggggtgaggaaccaatgagcttcaccatagaatttgtcttttgaggcaacaaatattttcccagcaaagttctgatcaaaacacttagaatgagatcagacaccatgattctgatctcttctccaaagaactagaaataatcggcagctttgggtgggagatttactggaaaaaagggaaatagtgtcactgtggaaatgatcaagcagcagcaacgtgagggccatggcactgttgtgaaaaccagtaggaaggtgcccagctattcctttcttagttaagtctatcctcctgcttctcctgagggtggagtactgggtgccgctgctggttataaattgggctatattttctgtgaatgtctggtcccaacatctgtattattcttcgctaaagaagtcactaaatatcagcatgaaaagtgggatgaagaggcccaagatgctgcaggcaaggaagagaaagaagagaaagagaaggatgctgaaaacaaggtgaagaactccaaagggacctagacgcagcagaggggaagctgagaaaatccaggtatcggtgtatagctttgagaatcactcaactattcctggcatttacctgttgctgacagttttattttaaaataaaattcccagtaaattaattaagaaaaggttttagtttaaaaattcaatttagcttacttaaaatgttactagaatattcatgtacgtagtaatatgaactgcagtgtgttctgaaatacacttcatggctactcatttgttcatgttgaggtcttttgtcctctagctgcaggactactaacaagtggcaaatgtatcagacctactacctaagatcaatatttgtgtagaaaacagttgccagacgcagcatctaacttgcttgggccacacattggttgggacttcattacttagccacagaaatgcaggctcccatagtaactaggagacaactcaatgccttttacaaagtgactactaacaaatagcaaaaagctaagaatttcaagtaggaccacatttaatgactaatacctaaatatttgtttagctatatatctttgtattttatgtgacaaatgaaaagaatgtgtgtaattaagtcttaaggcatatctgtctttgagtatatttaaatggttaacattttttcttttttctttttttttttttttgcattttcacagctgtattatttcataacagcttctttcccatatggtagatatggaaaccaagggtctgggagagtaagggagtatcatttgtggaactagcacaggctgttaaagcttgagagatttatttaaatcccagaattgcctctcatgtaaaaacaacaacaagaagcttttctggtgctagggagacaaggttggtgtgatcatttggctgtaaccatcagtttcacaagcaccctgatatccaagcttgcgagttacaaaaggaaaaggtgttcttctctacttgtttaagatatagcacacaaatgttgcagatatacacagagctggccattttcttctatttagaaagtcactggtgctggctaacgtaccattgtttatttttttctcatttcattctgtagttgggaagaatagaaagaagatgaagaaagaagactctgttgttcattgtttttattttattttattcagatgcctgtgagaattttaacacatatcattccaaagttcattaccttaaaagtgatatctagtgacatctaacttttatctttcacaaatgtatttgacagtgtttgttcaagttagaaataaaagtttgttttaaatgaataaattgaaacatggggagatttttcaataaataattctgactcaaatctctcttttacctctttgttttggcccaccataccttcattgaaaggtattactttccaccatttagtaagactgttttaaattcttttactgcagccaaaagtcaattaaaatgtcaagtttaaaaccatttttgcaaagagagagatggggctcaagtctttagagctgtactgtctactaccttagtcactagtaacgttgtggctgctgagcacttgtaatatggctagtctgtttgatatgtgctgtaagtgtgaaaataatattgcatatcttactaatgattttcatactgattacatgttgagatgataatacttgaattaaaatgaaatgttaaagtttttgttggtttctttttattttcaaatgtggctactagaacatttagaattacccatgtagatcacattacatgtctattggacaatactgctctagagcatggttttgaagaaaacttcatggatggcccaggttgcctggaagccacatggtattgctgagcttgggcccagactttgatttggagcagtggttctcaaagtttggtccccaaacagcatcatcagcattacctgggaattctcagactccacccaagacctacggaatccgaaaatctggggtggggtcagcaatctgtgttttaacaggccccccaggggcttctgatgaacactaaggtttgagaaccagtggtttcaagcaacagaggaagaagccgagcacctcctgtcgagccagggttaattcactggctcggggctgtttcaggtaaactgaaagggacagcaagggatgggctggggaggagactagaattcacaggggctgaggcctagagaggaaaaatgcataaaggaaaaagtcgggtccaaaaggatacaaacatgataccatgcatatgacttctaagaaaacatacaaatgatcaccataaattgattatgggtacatatagagagactaaaagatgtgcttgtaagagatgcatacaagtgtagcatacagaaaggtgtgcattcgaaagaagcacatttgagatggtggttacctctcagggaaagaaagggaggggcattctagcagagaaggctccacagcaggcatcaactatatttgtaatgttacatttcttaagctgaatagtagatatattgatgtttatagtaacattttctacaattttgtgtaggtctgaaatatttctaaagcaggaggaggaaggggagcagttcttcccacaccactggggcaggacttacaggagtctgagaattctagaacccaacctggcctttgaggtcattatgaaggtacatttgtcatggaaggagataaaccattaaataaaacatgctgtattcgtttatttaaacatttcaaatatttagacatatggtatgtggatcccaagttgaactcttgttctaaaccctgaaaatgttacaggtgagccaggctcattatctggcctataacccctttcccttcctccctccatgccactttgttacctgagcacagtagggccccttgcttctgaaaagcgcttgttgcagtagcccatcttgctatcggacttggactttgtccctgacccaggctacagtgcaaccaccaatcaccttgtctcttctgctcgtcccccaaccacaccccctctttattctccaggtgtccaaacgtaaaacctcttcagtggcccttctcccccataccaaatatcaatgctcacctgaaagccatcagcttggtcaggcacacctgcgtggacgcc[138 bp omitted]cggtgaaaccccatctctactaaaactacaaaaaaaattaaccgggcttggtggcgggcgcctgtagtcccagctactcgggaggc[136 bp omitted]agctctgagttgtcaatatcctatttgatttcccgccccatgtcacagacagagatggactacagaataggctttattgaatttatttgctttgcatatatcttaaatcaaaaaagttaaagaagtagaaaagttgtcagaatatgcctttaggcatttaaaaagaacttaatctcttcatttaaaaacagaactttgttgttaactgtggaaaagaaattgttattggagagttctcagagtgagaatagctgaatacaggttcactgtgaaaaaaaggaagggaggtgtaacagctgtgttgttaactgtggaaaagaaattgttattggagagttctcagagtgacaataactgaatacaggttcactgtaaaaaagggaagggaggtgtaacagctaatctaccaggagtacccagataaagggcatctaccttaatatattgttcactatgggaatacaaaggaaataaaattcactcaatcaaaatagcattatcaaaatggcaaaggcacagtatcaggaaaaatagatgttatatagagaaaatgcaaaatttagcatgtaattgtactgtgtcacattataccagcatcaacaaaacccagcaccaagtgtttagctctgacacctcactacctctctggatttttttgcatggggcagcaccccactcagaatataaaggcacagtcagatgtccaggcctgcatttctgtttaagcaaagcagcacagtgtaacagaggcagacacagtgataactactcagaagtcacttctgggtctcctagaaaaatgagctaggtttactgcccagacatccaaagggagctctcccttagtgtttggtgggtttgggggatggaatgaagagaaagacagagaaaggaagatttaactaacttctagtgaacctagatgagattctagggtggtctgcatctcagaaagccagccaattaaggaactggctctgggggtaaaggtgcctacatcttcatcctcagccgaggagttattaatggaggctgtgctacaaaagaaaaagaccgtgtggcaagatgggaagggaggcatcaacatttgctgggccacttgccccctcccctcacagctgaccatccctctcatcctctttctcactctccctttttggtcttccctcttctccgtggctgggggatgagtgggtcactggaaggtagggtctctccagcctagtaacttttgaggtgtgtgcctctaggaatgagaggggaaaagctgatttactcacttaaagcttccaggtagcggaaagttcatttctctgtggctttgggattgcactcttgctttgggctaaaaccttgtgaagcaaagacagctgaggggaaaggacaagaagctacatggagttctccaccttaatgctggaaccagagaggaaggagctccagtggctccagatgtgcatcaaggcagtaagcttgccatctgcctgatggaaagtacagcttttggcatctgtagaactctaatttcaatagggtcttcagtgcttaacaggatatatgtgataggcagtgatttctgtgcgatcagagagggtcacagtagtattgggacaagaagcaaaacattgatggactaaccctccagaggagtaagataattcccaagaagcattctgcgtcatagggaggtgctcgctacagccaggcctgtgacaggtcgacgtggggtatgtccaaagagggagctttgtgtaagtgctctgcatgttactatcacccaaggagaaagcatcaggggcccccagggacacagggaagatgtttcaaggggtgataggctgattggagaactggctgtgcagaaattttcttggagacccagaattttcacttccaccgcctcttttaggatcccttgcaaagcttagagcaacaaccaaataattgcggcatctatctaggctcataaaacctaaaggccaatctttaggtcaaatcatctgaatgtttccattagaattactttatttggttgagggaaatgacaattttctagttgctccaacaaaatgtttttgctttctcccttctaaagcacattgtccaaagttaaagattttgcaattttacagcagtgcaaatgttttcgatagttttaatagaggaaatgctgggtttctgggtgctggcagtgactacgtggaaggttaagcattcatggcatttatttcattcaaataattatgttttaatttgcatttctaaggctattttgcttaataaattcttattttgcttaataaattcttagtttgcttaatacttattttgcttaatacaagtggtcacagtaaaaagatcactacatagaattaatacagctattagcaattatcatttaaaacgctgatgcttggccgggcgcggtggctcacgcctgtaatcccagcttttgggaggctgaggcgggcggatcacgaggtcaggagatcaagaccatcctggccaacatggtgaaaccccgtctctactaaaaatacgaaaacaaaattagccgggcgtgatggcgggcgcctgtagtcccagctagtcgggagactgaggcgggagagtggcgtgaacccgggag[143 bp omitted]tttctgccatgtggctccatgctttggctttcttcctggccagtgagaaccagacaggctcaattggctcaactgggttctggaacttggctgggagagttgaagatcgtttggtttctttttccatggcaggaacttgcagtatcttctgagcttcaaatccaactggaaccacagcaaataacacacaagcaataaggaaccccagcgatattggggtatgttgtttatggaatgccatataatgtttcctcctttcaggtttcctctgatccccctgctctagtgctttctaaactcttctccctttggtgccagacttctaaaagttaggacctgtgtgatgccatgggtagtatgtcaaaggggtaaaatcaacttggctatggccacagggccctgggcatgggaaggcctgggaggtaatacctatggctgtaactgccaatcttcaggtggttattactggattgtcttacatctttgaactgagaccagagggaaacatattgtatctacttagtttctaaaatttcagataaggtaatgttatttgtgtttgccaatccacgatttcatgtgaaatgaattgattgatgacttaatagatgcacccagtaaaagttgatgataaataatattgtaccaacccaactaccccagccaaggagactacctccctattcctaattccactccctccctcatcctgcttatggtcaattgacttagtgacttagaatcaaccagtggttctcaatcctggctacacattagaatcacctagggctcttttaaaaacaccaaagcccatgccgtttcctgaagcaaatgaattagaatctctaaggatggagccaggaccatctgtaattttttaaaaagctcaccaggtgattctgatgcacagtgacagttgtgattcacttgataggagtatagtgcccatgaggccattaaaagctgtgagcaagtcaactgctgctatttcatggccagaaaatgggttcctgaattcctggtctaatttcttcatgagcgggattaagggagaggacaaagatggttcaataaaaatccatcatccactcccctgctcctgctgaaaaaattctctctagcacacaattctttctggtgagatcacattctattatatcccagcagagtattcctctcagctgtcaacatttcctcaccacttacacatccctgctcagaatacagagaagcttaaacaagccttctaaataattaaaaacaattgaataccattgggcctttagagtgaattattttcaacagtttcattggagatgtagaaagtgagaaaataccgctttgctatgaactggaaagtgacttggtactttcctcttgcatacccagccagaagaatgtttcagtgagtgaccacagttttgtgcctagacagcttctttgatgaggcaaaagactggaagaccctctgaaagttatacactggacttgtattagtcaaaataattagattttcctaaaataagctaatatttgtatctaattaaagagccacgcgagaaatcattaagctgacttaaggtaagagacaagtattatctgagcttgaaattgcaaaagttttacaacattctgtcggggctgttttttgagaggtcagaatgtatgcttttacctgattttgtaggcttaggtggcttcatctgtgctgtcttctcctgtttatggacactggaagtgaacatctttttaggttggttttcatttgcagagccagctccctttaatacaaaaatgaaaacagaaagcttgtaagttctgacattaaaatggcagattgcttattcagaggaccatagagtgcaagccctgtcctgggtactatgagtttaacagtatccaaaaggaaagagattagaaatatagagatagataaggagagaaatagcattgagccttttggcttaaaatttaggttcacaaaacctaagctggctcaagtttaccacctttcagaccagaaagaaagagctgtctaattttacaaatagtgaaagcaggttaacaagataattatttaacttgagaacaaccttttccttagcactttaccagcacttaacagcaagctaacagaacatggtagttgcaaacaaatctgatcaattcactgaagtgagttccataagatttctacttttcaaaactagctgacatatgacttgaagcatttctcacattagaaagtaatataactgtaggtctttccaaaattctgcagtttattcttttcaaattaacctcttcataattggtctaaattaatgagtttatatacactaatgtatccctcctgacaaaagctttaaccaggctgagagcagtggcctataatcccaacactttgtgaggctcaggcaggaggatcacttgagcccaggagttcaagaccagcctgggcaacacagtgagacccatctctacaaaaaattttaaaaattacctgggcatggtggcgcacacctatagtgcctatagtcgcagctactatggcggggatgaaggggaaggatcgtttgagcctgggaggttgacactacag[132 bp omitted]taaatactaatgatgaaaaagaaaagacctttaaagcaaagagttaaacacctcctcgcacagtccttcaacaaatttagtaagcacttaaaagtataggagcttagacatatctcttgatatatgaatttggtatgtttccttgagtcagttttctgcaggtttgataagaggggagaaaggcatcatcccatcatctcttatccacatgtggtagttagcctagtttaccacatcacattttataacttacaggtaggtgccacaccaaaccaaatcaatatgtagaaatccaaacatcaaacacagaaagggaacttgttgtgtactgatacagaaaagtgcccagaaataaaatgttaaatgaaaaaaacagtatttaagtttgattccatttataaaaatatatatacatattgataggtataaaatatctgtaaagatagtcactcaactcttaccccagtgattacctttaggtatttttttaagctatgaggatgcaaaggcataagaatgatacaatggactttggggactctgagggaaagggtgggaaggggatgagggataaaatactatgaactgggttacagtgcaccaaaatctcacaaatcaccaccagataacttactcatgtaaacaaataccacctgttccccccaaacctatggaaataaaaaattaaaaataaaataaaatgacttactccttatttctcaaccaatttcgtggagccttgctttagaatattgagggcaggatttgttttgcagattctctctatgttcatgactttgcacaacacccccgcacacacacttttgagacagggtctcactctgtcacccaggctagagtgtagtggcgtgatcttgactcactacagcctccatgcctgggctccaagtgatcctcccacctcagcttcctgagtagctgggatgtcagcacatgacaccacacccagctgtgtttttgtatttttagtaaagatggagtttcagcatgttgcctaagttggtcttgaactcctgagctcaagcaatccacctgccttggcctcctagagtgctgggattataaacaagagccaccgcacctggcctgcacaaaccctttaagagcataaaagcagggcacgtttgtataaatacaaagcaagtctttttccctgaagagtcctcctgccttgattaatgttcccaaagagagggggagctgcatgttggcaaagttcccaatagaaacctaatcagtgattccagcaacctttttggagtgttttattggctaccccaggtcctacctcatatttaggctccttagtctcagcatcggctccagcattgctcttagttttcagctctttcacagaaatgtgggccttgaaactcttctgcttctgctttgccatagttatccaaaccggctctgagacagcataatctgactgttgaccagcaggctttcctgagaaagaaatgaaaggagttagaactgaagcaaggcaggcagggtcttgagcctggttggggcttacccacaataatatcccaaatgggacccttgttaattgccaaaggaaaataaacagatatcaaacagagaaggccccccttttttgggccctccctatagcttggcaaggcaggagttccttgggtagtaaagaagctgtacttaaaagtgggcccttcccttgtccatccctggtgccatctgcaaatcagagtaggacaacgcttgccaggtgggctgggaaaatcccaaggatgccagaggctcaggccattgatgccattcctctaactcctagaaaaatctttgaaaaatctttgaaaaatcctagaaaagtatttgttacttcatagtccctcacacaagtgtgtggttacataagtgtggttacaggaatataaaagatttttccaaggatggagtgtgaaggtccaaaggttttgggagacattcgtgcccaaaagatcgcctagctctaaattcttagatatttcagatgagcgaagagacatttatggcaaattaagatttcaggctgagagactgaacatagtgctctacgaatgagttggctttaaaaatccacatggtgttagggaggggcttaatacatgtaaaagtattttgagaaaagcataaaattccatccaaatgtaaggtgtgcagagggtgaggaagagggaatggggaaatggtcatgtgtctactatggaatgtagatggatgtccagagggggatcccattaggaaagggaaggctcaaaattaactacctccaaatctattaaatctagaatggggcactattttgctcccaaactcataaaccagccctatcaaagccacaattcagtaaaagactagaatagactttaatgcccattcaaggctttgctttccagttgtttccacttgatatctgcttgccatctggagagataaaagccttacctggggtcttgcaagcaggttgcttcttggccatgctttcagatttgggcctgctctgttgcttatctgcaacgtaagatattttggtgaggttccctgcagcatccaggagcccctgggaagtgcttctgattttatgtcccctgcctacagaggatgaaattgggcccgagggcactgaagcaagctgggtgaagttatcttgtttctcactcttatacttctgcgagggaggggctcttttcagtcgaactccaaaaagcttttcaacatcatcctgattggataggtttgcatgctggttattattaccatcaccactctcaagatcttctttcttagagtaaatgcccccagaagtggatgtttgcctgacaggagcaatggtgaacttcccaggtttggtagcaggggctggaatgctctttatggggtttttggaaccttggctgaatttcttggttttgattgcaaaagcttcatctcttcctaggaaccaattgtcagaattgctctcaaaaacagatcgcctagcagcagcattcacagaacttgaatgaacctgttgctggaaaggactacttgaaggcaggtgcttctcaccgctgctctgctttacaggtacattcactgggccctttgatgacatctgtggctggaatttagacctatctgaggcttgggaagaatgtttgggaggcagctgctttttagaattcctccactctttaggagaactggcagaaacaggggagactttttgctcatactcaggtttcctcaaggcctgggaaagctgcctgggagacagctgctctttaaaactgctgcacttcccaggagctctctctgaataagagaaaactttctgtgggtcttcaggcctccccaaggactgtaaagggtgcttcataggtagcatctttgaagaaatgcctcccttaggattagcactccctgaatctgagaaaacttggtgcttgacttcaggctttgataaagatttggaaggaagattgggaggcagaggtgccacatcactgcccctcttaagagcagagctctctgaaaagatttgctgtgccataaatttcacgaatgactgggtcggacgcctgggaatcggtgatttgttagaagtgccttcaacagccattttctctagtcgtgaggtcatttcctgaactttagacctctttaagaactgggtagcatattggggaggcaatggactcccagaaatgtctgcctcaatagcagcccgctcgaaatttgaggacagttgctggactttatttcccacagtcaactgggaaagatgtctgggaagcagctgctccttagaaatgtcctcttcaacagtagtgctttctggatgtgcagagagttgatacagttcctcaaatttaggggtcacccatggcggggaagtgtatttggaaggtgttggtgccacaggactgctccattctgcagaagtactcattgagtccaggaacttaggcctctccgagggctgggaaaggcatctgggaggcagcggttccacataagtgccttcctcaacagctgtgctttctgagatttgccggatttgaggatctgtcaaggactgaggagaatatctggggagtagtggctccacagaaatgactctctcaacagcaatgtcctctgaacctgagaacatgttttgttgaactttaggattcatcaagggctggcaaagaagtttaggaggcagaggcttcatagaaatgctctcttcaacagccatgctctttggagatgaggaaacttcttgctccactttagggttcacccatggctggaaagggtgtcttggagggattggctccacggaatcgctctgttttatagaagtgcccactgaactggtggggacttgttgctgaacagtaggattcataatgggctgagaagggcatctggaaggcagctgctgcataaaatcattctgctcttcaggagtattatttgaagcagaggagacttcttgttggtttttgggctttcccaaggcctgagcagggtgtctgagaggcaggtcttcctctgagctgctgcaatcatcagaagtgttgtacttttcaacataactgcttgattctgtgaagacttctgcatcttcaggctcctctaaagcctgggagaggcatctgaggtccagctcctcctcagagctgctcaagtcctcaacaaaactttttgattctgagaagacttcttgttcatcttcaaacttccccaaggactgggaagagtgaccatgagccagttcttcagaaccatccccctcctcaggaatattctctgaatctgaggagacttcttcagcatcaggcttccttgaggactgaaaaaggcttctgggaggcagagtcttggcataaacatctcctttggctgtagtacttgtcatacccaaaacacttgctgtaaaggtctggtgaacatttccagaaggcttttctttgcagatagtttgaacatcctgggctgactccattttggattgggccttttgtaaatcaaagctgaaagcttcttgatcttctaactggatatgagaaggattcataaacacctgagcctctgctgctactgagagaatggcctcctcttgggttgtagaaaggctttccaccatcagtgagagagaagctctggcttctgtcttctcagctccagaagctgcatcttcatggtatggttgtggatcactaaccatggaattgtccatgttttcaggtatgggctgtgctgctgatgcttttctggatccgaaatctatgccagcatttctccttcccatgtcatctttatctgaaagcaacccctgaggggtagtggtttctggttgtgaagttgtaggctgctccatgttgtccttctctaaggacaagtgcgagaaagggacattcctggcagtcttattggtaggtgaagacccagctctatcgcccaggccatacccttcactggattgtttaaggcttcttcctttgaattcacacccactcaatcctgaaacacttgctccttttcttctccatcttcttccatatgctgctgacattggatagccctgactccgagaagcatcagtgtttggagcctggtctgttgtcttcttatcatacatctcagttttgttgttctgtttctggcttgaggaatctgcaccaaacagaaataaggaaaggagaaatatgtgtgactttcacttcctaaaataagaatactgtgccctggcccagtggtacctatttgctactaaatttcctagtatgaggaagcagctatttggaagacagagggcaacatggtcactattaggtttctgcagttggatatttttaagccaaagagaaatcctagttctagaaactgactccagggttggcttatcacctttttaccaatagtctggtccaccattcagtgtgagacacatcagaaggcaaattttgaacctgtaacaatgactacctgtggggaaactgactggggaaggaggaattgaattttttactttctaattagcatttctattttctacataatatttatctgaactacctgaaatttcatatcatgtgcatgtattgctttttttttttttttgagacagaatctcgttctgtcgcccaggctggagtgaaattgaaaattaaattgaaaattaattatggttctattttacactctacccaaagacaaatttcacactttgaattcatacatcataccaggctgcagtggcgcgatctcggctcactgcaacctctgactcctgggttcaagcaattctcctgcctcagcctcctgagtagctgggattacagacacatgccaccacgtccagataacttttgtatttttagtagagacggggtt[133 bp omitted]aataggagttatctgggaggcaagattatggcccccttttcttctttttttctaccctcttacattaaaacaatcctagttgtttttatttccaagatgcagattggaggcattgttagcatgtctctcccacttggaaagacaaatagcatgtagatattcatgctgtgagctttttccaagaagcaacacaggaacttaacagaaagagtgaaagaaaccacagaccctttgaaagaagtgatgggcagcagcctacactgtgaaccagatggaaaactccccataggagacagtgaacctgcgcacacacccagcacatcactactacagtcagcatctgagaaagccatcacacaaagatactctgcaaccaaggaactcatacagagtcttcaaaactgaaagcacccagagctgaagccaggtgacaataaactataataatccattaaaaagtgggcaaaggatatgaataaacaattctcaaaagaagatatacaaatggacaacaaacatatgaaaaatgctcaatgtcactaatcacgagggaaatgcaaattgaaacacaacgcgatatcatcttacctcagccagaatggccattattacaaagtcaaaaaacaatagatgttgggatgaatgtgataaaaagagcatacttatacaccgctgctgggaatgtaaattagtgcaacctctgtggaaaacagtatggaaatttcccaaagaactaaaaatagatctatgattcaatccagcaatcccactactgagtatctacccaaaggaaaagaagtcattatatcaaaaagacacctgcacacatatgtttattgaagcacaattcacaattgcaaggatatggaatcaacctaagtgcccatcaacctatgagtagataaagaaaatgtcaagcacatgctagtagttgtacagattactcctctcctttcttctagtacttttctaaggaactcactttgatccccagatggaagggtccctcgctgcctttcttccctcactatctgctgcatccctagctccatctaggggtttcatacccagcatacggcgctgagaatagctgactgtgctccaaaccactttcatgatatggaaaatcaactaaagaaaatgtgatactactcaggcataacaaagaatgaaataatgtcttttgtagcaacctggatgaaactggaggccaatattctaagtgaagtaacccaggaatcgaaaaccaaataccacatgttctcccttataaatgggagctaagctatgggtatgcaaaggcatacagagtggtatattagacactgaagactcagaaagtgggaagggtaggagggggtgaggaatgaaaaactacataatgggtacaatgtacattactctaatgacaggtgcactaaaatcctagacttcaccactatacaatccatctgtgtaaccaaaaaccacttgtacccctaaagctattgaaataaaaacatttttttaaaccgatcatatgtaatacacatgcaaagaaattcttggaatgccttaagaattgcattggtccacaggcttcaggtcaagcacaaggtagtagttgtacagattactcctctcctttcttctagttctaaggaactcactttgatccccagatggaagggccccttgtgcctttcttccctcactatctgctgcatccttagctccatccagtagtttcatatccagcatacagcgctgataatagctgactatgctccaaaccacttccatgatatggaaaatcaactaaagtatctgccaccatggatactgactcagttctatcctctgtgtgtaaaagagacaactattaaaaaataaagctcaaaggctgggtgcagtggctcacgcctgcaatcccagcactttgggaggccaaggtgggcagatcacaaggtcaggagattgagatcatcctggctaacacggtgaaactccctctctactaaaaatacaaaaaattagccaagcgtggcggcgggcgcctgtagtcccagctactagggaggctgaggcaggagaattgcttgaactagggaggtggaggttgcagtgagccgagatcatgccactgcactccagcctgggtgacagagtgagactccgtcttaaataaataaataaataaataaataaataaataaataaataaaaataaagctcaaaaagacaaaagagtactcatttaatcttcctttttctttttttttctggagggttttgtggttttcttagtattcatgggaaaacgtgtttaggaatgtcctgtctttggacccacatgtgaaatcctttgtggcaaaaacgtaacataactattcaacttaatttgaggaactggaatttttttatcaaatactgctagaaatcagcttgccatcaactggagccaacatccacatatgcacccacataaacacacagagagattttcactctggtgatatttgttgtttggggatttgataggtgttggctgccaaggacatctgtctgcagctgcataaaccctctttgtccaaggatgtgggcaatagtatcattattaacacagacattttctctctacaggaagagaaaggcaactttaaaaaaatgattttttggccaattctattattcctttctggttctgctgctgaggaagaatgctgaaggggaaatcagtggttgtcctctcatatctgggctcactgaggaactcagcatgtacgttagcctcggagaggatgaaacaaattcacaaacaaaacacctctcttgttggaaattcatttacataaaataagaatccaggtatgatcctttacctgaaccccacacaagtggcaattgtattactttggcagtttagatggagaagcctggacaacattttctgcatataaaattgaaagctctctgaagaccaagggcagcagtcttgggtagttcttgggtatagctcctatcaacatagcactgtgcaatgaagtctgtcatacatgtttctgggtgagggtgaagatatgctaacctgcactgtccattcccagcttcttttcgttgatttcttttggtttggttatgctcttttcttcttcagaaaccaatggaaggtttggctcctcctcctttggttccacctgaaacaggaaaagaaagagcttgaatcctactgaagtgctttccaaccacgcctgcatggttgccaaagaaaaagcatcaggaaaaaagttcttgatgctgggcacgtaacagtacctttaaagatggacgttatttcaatggagatatttccagggatttcttaatggaattgtttccaccaagagatccttggggatcattttacctactggaagtggttcatccaggtttggagtttctaatgtctgagtgacacactgcagggatccctctaaaataccctggaaatgactgaaccacactggaaggccacgaatctgaaaacggggtcattgggcctgacaacaatcatgccctcggccatattgggattctccgatttgcttcaccagacctgtgagtcaaattcaaatcctttttggcttcttttcagggaatgtaatgaaagcatgaattatctctttccagatcaaaagaagaaaaagaattggggttttgttgggagggaaaggagaaaaagctgaaaggttcagcccttacactggatgggctgaagttggtttagtataaataaggttttctgataattacaatacagctctggaaatgtcagcatagcactgcactgaacagtgtccggaatttgcttagtgtaagcctttatggcatgcatgtaaagacaaacatgtaactctttacactcccactcaaagtgcctgtgcaaacagacacagctcataataatttatttttgagtaaacgtggtcagattggcctggattcaaaatctcttcatcatttacttgctgcgtgaccttgggcaagttattctctgaatcactgtgtctacatcaataaataagggaccaggagaaacctcctgtgggacttgtagatctaagaaattacagagcagggagaaagtggtagtagtccctgtgtcataaatgatcctggatcttttttatgttcatccacatgtcagagagagagtcacagggaagaagtggatgctctggccttctcagagggtaatgcccgggctttttctcaactaggctatacagaaagaagaaagttagaagggtcatactgcttccctcagccaaccttctccatctcccaggtttgtggtgaggtattcaggggataatgcatgtatagggtttggcacctagtaattggtcaccccttctttgacaccaaactaacaaggtactctcaaggccaccagagggcttccctctgccgccctgctcctccacctgttctttcaactcgtattttgtctaaaacctaaagtgaaattgagatgcctaagctagaggcaagatggtgggatgaaaaaagtgttgagctggaagtcagaagactggattctggccctagctctgctatcacctgggtgtttgactttgggtaagtatctgaaattatttgtgctttaatgcccttctctgtaaaatgtttgtactatacaatcttttagtcacttcacctctgatttacagtctcttcctttcagcccagaatcactggcgaattcagtttttgatcaaagtgagttttatagacaactgacacatcgttttaaacactaaacactaacattttttaactttttttttttaaacggagttttgctcttgtccaggctatagtgcaatgacacaatctcggctcaccacaacctccacctcccgggttcaagcaattctcctgcctcagcctccagagtagctgggattacagggatgtgctaccacacctggttaattttgtatttttagtagagacggggtttctgcatgttggtcaggctggtctcacactcctgacctcaggtgatccgcccgccttggcctcccaaagtgctgggattacaggcatgaaccattgcacccagccctaatccttaacttttactaaaagccttttccaaaagcattatttctctatctttttaaacagggatcacggaaaataatctactttttctagatgacttggacaaataataaaattatctattacattggactatgatatagtgtggccctgaaggacatattgaggtgggcaaggttcttgagcccctatattaaatggccccagattgtttctgtcattctgtctgctaccagctgtcacttctctttgctgtcaggtctgagtctaatctgtggccatgtttttaacacagtaggtctgcttcctggaaagtcatgtggcatctatttggagatctttggatgggttaacaactaagttctggatgtttagggttgctgaaagcttgatctccaaataagtggaatagtgctgcaatttgtgactcatgggtctcatctgattaataactgaaagaatcctgatctgggctagggttgaatattctctacaaatagggctgagtgaactcccagatgttagcccaataagcagtttatgggggtttaaatcatttactgtttctgcttccttttagtcccttctaatataagttccacatggataggaaaccacacccagcagatgcaagcttgctcacccctctgggggtgtcaagcttaggacagcacccttgaccttgccaagcttacttagggcatgagtctcctacaccatactatttccctagtagtagtttgcaaaggttggaactcatcttttcttatacaggagtttagtgccctgtctcttgaaggacttacaatcacttgaaggttcttcttttgtttgcggggatttaaagtcattttgtggcgagcagctgaagaatccaaacagccctgggtggtggctggggtgctgaaaccaatgggcagctgggtgctactggtagaggcaagtgtggcaaatgcagtcaaggactgtgagcaatcaggtccagatgataactcagagaagctctggggaaggtgggagaaaatagacgagtcaacccgtatgctgttactggtctcaaaagttggatattcttccggctgaagaattcccaaagaagaaatccttcatgaactattgtcccctttcctacatttcctgtcaatgggcttattcattagaggtaagctccataattttactggttttcttgcagatgaaaacaagaaacaggaagaagtttgggttactcctctgcttagaaagctttcaggggcaccccattgtccttgggatgggaacacaaccacttaattgagtttgcaaagtcagagagattgcatgttctcttgtcctagatccccttcttatcaacaggacatctggctggggtgagaggaacaattggtatcagtgaaacccagcagagctctgggatttctatattggagggttgggtggagggaggaaaatcaggttggaagagggcctgtctgcaaggtgcattttcatagacagcacactaccttttatttatattgacagttcatgggtgcaagactgatgggaggaccctcaggaactgaatgctctaacctccagtgggatagtgatggagcctgtaaccctgtcctcattatggctggcctccatatctccatactatttggttctgggacacctagttgaattcctctgtaggatcttcaaaatagtctcctctgggcttctggacatagcattttccatatctcaaagagcctccccagagctctttccatttctaagaagatttcgatttctgttagcagaaggccctttgaagatcagctgataaactgtctctgctagatactagtagcaaaccatatattataatttagcaagtagacagaatctcccattgtgtttacccactaagttctcttcaggctagttttgcaaagtgccaggtatccccttggtacttgcagctttcacatgccttcatggttcccaccaccattgtatgttgatgcagtgataaccttagctactatcttggttatgaagatggcactgtcattccagtgcatggggacttaacgcagtgctaatgagtcaggctgatgacaaatcctgcagaccattcagttttggattcagggagaagacagagaaatagtacagttgacttttgtgggatcaatcacacaaaagtaggattgatcccaagatttcctttacttctttgtgcaactttcatctatgaatttatatactgcctcttcctgatatcatctagttagattatgttatctactggaaatataaatttgatatcagtgtatagactaaaagctcttcttttattgttctgaacatctttcatacctcagagtggtgtcatagttctggtcttttggggctggaggataacatctatgctcccactaacctcacatgatctgtcttccttttatccctgaccacattaccagccatttcctgctccagacacactgctggtctgctgttcttcaagcacttcaggcatgctctccccttggggccattgtgcctgctgttccctctgctaggcatgctcttcccccatgtccatgtggctagctcccctacttttttcaggttttgattcaaaagccaccttttcatggcctggtgtggtgggctcacgcctgtaatctcagcactttgggaggctgaggtacgcagatcaactgaggtcaggagtttgaggccagcttggccaacatgatgaaactctgtctctacaaaaaatacaaaacttagccgggtgtggtggcagatgcctgtaatcccagctacttgggaggctgaggcaggagaatcacttcaacctgggaggcggaggtttcagtgagctgagatcaccccactgcactccagcctgggcgacaaagcgagagactccgtcaaaaaaaaaaaaaaaaaaaaaaggcaccttttcagtgatgtcttccctggccaatctatttaaaatgtttgagccacttcatatccccttccttacattgtttttctccctgtcactgttctcactgtctgacatacaatatgttttccttatttagcttgcttattgtccatgtcccccattacaatataaactccatgaagaagggtttttatctgttctatgtactactgtattggggatacagtacctccaactgtgcttgtagtagttgcacaagcactacatggtagttgctcaaaacatgttttttgaactggtgacttgattacgttaaaggcttccaccagaagttgcctttctgagatgtcatcagagcaagctcctctgttctctgtattattttagttattctttctgaggcctcactagctccagccaaaggtaaaaggagaaaaacaaggaggtctatgaatctggaaaccctaaaagaacaccgtacaacttgctttgcatgaaagccaacttatgatgcccacatggcaagtaagtacatatttaataaatataaagaactttcaattcagttggcatcccaaaccttgtggtataaacactaaagatacttaatttactttagtgaaactcattctatagcataacagaaaaatcaggctcagcaaaaatctggcaatttctagattgggtatgtgcaggacagagtttatctgtttccaatcacagccgaagccaagagtccatcaaacttaataacagccactgatctccctgtgttagcttgactctcactaaggaatctatagacatcagtctaaacacagacccacatccattctcaaaccggggctaaaaattaaagagcaaaacgatcaagcattctcctcatctgactatggagctcaagctcagacatgtgatttaaaacagtcttaacaggatctctgttgttaggtttagagtatgttatgtgggtatagattatatgtatatgttatgacttcccttaactcaccagtgaattaaataaactatacactctctggaactctacacagtatttctcaatgtatggtctggaatcccccagcaccaaaatcacctggaatgagtgttgaaaaagcacatttcggggacatatcaagacctaatgagtaagaagatcaggggaaaggctttagaatagctttaacagggtttccaaatgagtcttccaggagccaaagttgagaaccaatgcctagtcctctagcatgaagagaacggctcccattttcaaatatgagtacagcaagttcaggaataatcccatcagttgccttagaacaggagtcagaaatatatggattccttttgggaagtgtggctccttcttaggccttcttaggtcctctttccctcagtcctattggttagcagcaacttagaagagttaccacaggccaggcatggcggctcacacctgtaatcctagcagatcgcgaggtcaggagatcgagaccatcatggctaacatggtgaaaccccgtctctactaaaaacacacacacaaaaaaaaatagccgggcatggtggtgcacacctgtagtcccagctactcgggggactgaggcaggagagttgcttgaacccgggaggtggaggttgcagtgagccgaaattgtgccaccgcactccagcctgggcaacagagcaagactgtctttaaaaaaaaaaaaaaaaaaaaaaaaagctaccacagaagccaaccacaggattttatgagttgcccaagaaaagcaaatagaatcccttcctggcagaattctgaaagaaaaacgagtggagaaagtgggacacctttctctacttttccatcctcactcccctccaaccctacttctccttccacgcactctgacagccaacataccctgtctgaacccaatctgcatattattttttcgttcgtataaatctaaggggtagaagcgtagcttattacatggatatattggatatatcacatagaggtgaagtctgagcttttatttttactgtaaccatcacccaaataatataccttgtacccattaagtaatttgtcatccctcaccctcctccctcactcccactcttccaaatctccaatgtttatttcccacactctatgtccaccgtgtacacattatttagctcccacttataaaggagaacatttggtccattatgtatattattaagtacagctgagatgttttcatttcttctcctgtgttttagagagagtttagcacagatatcttcagattaatatctggaattaaatgggctccttgtgcctcaacatctgggagatgtgcccggcctggtacctactaatccagaatcttcttagagaaggaacctgggttggaccttgggccaggggaaaggattcttcagcactggttagtagagagctggacactcttttgctgttagctgggataagggctgctctttggaaaataataacacattttcacttcttttttcccttctgtcaagtttctagacccagtgcaaaggagtttagtcaataatgcacattttggtagtcctttttaatgatttctttttctgttgtatgatgctagggttttccccttttgagcagggatagagagaaggttgactgtcttcctggaacaaaggaaagctctgattgtaatgtcttaaataaggggattaccaggtggctgtctaggcccagatttcatcaagcatttggcccataaagctgtcactcttgagaaaaaatacattctgaaactgacactgggatgttggagagttgggttctatgtgagtcaaaagctaaaagcatgtgtctatctccacaagaagaagcgactcttggtgggaaatgtggttcttggtgggagacttctgcaccaagaggtactggcacagagtgtgagacccaataatggctgtagggattttaattctctgggtgtggcaaagtggcttctgtgcccattcctgagagttcctgcacagctgctgcttcattcaaaatctatgttacttaaaagctgttgtggtcaatatttttgccaacttgaaagttcttagagatggaatttctggtattccctgcagcccccttctatcacaatctcttcaatttcttaactagtatagagaataagaacatggactttgaaaccaaataggcctgaatatgacatcctagctataccacttattggctgtctgaccttgagcaagttccctagcccttttgagcctcagttttcatgtctgtaaaatgggaataatcataatacatactttggtttgttgttgtaaagattaaataaaattatacaaggaaagtgtttaacacagtgcccgttacataagaaagtcttgataaatgttagctgtcgttgctattgctgggcattggttataaaaagaggactgctagaagccacatagttcagtgaaaagtgctatggatttggtcaggagtcctgggatcaagccccagctctatctttgattggctctgtggccttggccaagtcacttcacctctctgaacctcaattttttttgatctttaatgagaatctttcctatctgctttacagagttattgagagaatcaaatgtaactatataaggaaaatcactttgaaagttgtaaatttgtatacaatcatgggagggagcattatgttctcctttgatgtattagcggattttaaaactaaaattttatttcattttagagacagagtctcactacattgcccaggtggaagtacagtggctacacacaggcatgatcatagtgcactacagcctggagttcctaacctcaagtgatcctcctgcctcagcctcccgagtatctgggactacaggcatatgcagcagaagattgctttaaaaaaaaaaaagatggctctgggcttcggagacttatttgtatacaatgctggggaattatggtgtaagccatccaggtaaagcatgagatattataaaaagaggcatacttgtagcactcaaaattaactctttattagccaattcagtggaataacttaacccccaaatgttaaatgccagcatttatcctgcaatgtgactgaggccagggaatttaatcagcccaaactttaagctttaagaattttaccctgacaatgtatattgatagcttatcttcacaggtgtgggacaaaggacaaaactcaaactcatccgtctgctcacctgagacaaatgcatatttgattgcttcttctgatgtaaaaatgcagattcactgaggaagatgaaggcataagtgactattcctctaccccctctcacatgtaaattgtgtattcagtgaaaggctgatcaaagactcaaaaaaatgcaaccatttgtctcttatcttcccacaccttttaaaaatgtggtcatctttccccaatatccgccttttccccctttagacattgaagccctcaaaattatctttggagaaaggcacagacctgcctcccaggtgcacatccttaaccatggcaaaataaaatttcgaaattgtttctgacctgtcttaggtacttttctggtttacaaactcaacaacaaaaagataaataacccaattaacaaatgggcaaaggagaaatagatatttctccaaagaagatacacaaatggctaacaagcacatgaaaagatacttaacatcattatttactagagaaatgcaaatcaaaaccacaatgagatactatttcacacccactagcatgactataatttttttaaaacaggaacctaacaagtgttagccaggatgtggagagattggaaccctcatacattgctagtggggatgtaatgtaaagtggtattgctgttggggaaaacagtttggtagttcctcaaaaacttaaacatagagttaccatatgacccagcaattccactcctaggtatatacccaaaagaattgaaaacaggtgttcaaacaaaaatttgtacaagaatgttcataatagcactatacacaataaccaaaaggtagataggacacaagtgtctatcaatggatgaatggctaaacaaaatgtggtacatccatataatgaagtattatttagtcataaatagaaatgaagtactgataaatgtcacgacatggatgaacctcaaacacattatgctaagtgaaagaagccagcacaaaagccacatattgtatgattccatttacgtgaaatatccagagtaggcaagtacagagatagaaagcagaatagttgttgtcaggggctgatgggagatacgaatggtgaatgactgcttaataggaacggggtttccattttggagaaccaaacaggttctggaccttgatagtggtgatgattgtacaacattgtgaatgtatgtactgtcactgaattgtatactttaaaatggttaaaatggtaaattttatgtgatctgtattttactacaataaaaaatgttatctaattcaatccttccactagttcagattatacatcccaattcatctgatttagtggcattctgcagaaaatacttgtagtcatagcccagatccataaaacaataagcatccatccacctactaccagtctgtgctttaactttggttttaacctaatttctttgttgacatatctaactgagggctgcttcacttcataggatcttttaacatcaaaatagagttttgttctgactggccaattctcttccctataaattaggtttctgtttactttttatttccaaaggttaatcattctaaactctacctcactctcagagccttttcaagttcaccaacaaccaattcaattaaacacacattagtttgagaatggaagtgttgatatgagcacacactattatacgctgattgatattatctggttgacaaacctagacatatgaaatagacacatcgccctctcacgtgtcaactgatttttcacatggatatgtgtctatcaaataatactatatgtcctaacctctgatttttttggatttctaagtgtagagtctatgcttcagtaaaagtctgtatttttatcttcatgaaataactcaaaacatctgcaaactattattttttcgaaaatactatcttcccttgcttatacattaaaatggtgattatttggtttgtagaattggatggaaaaccaccatgcaaatcaaaagccaagaatgtcaggtccttccccaatcatccccctagtgttgagctccagcgggagaatagatgatacaagaagaagttatgcctctgatctgtgaggcccctcaacctgtcccttaatatatactcacctgagtcgctgtcaaactcttatgtggtaaagccttcttttgtggattcttaggtgactcatcatcgagagagatttctaccaagttcttagaaattatttcaggttggataacaggtgggatgatgctgagtcggcgtcggcgcgatggtgggttctgtcaagagggagaatagaaggaacaatttaaaacctgtgctctcttcctcaaattagtggttttctcttattctttaataagagtaaggaatccaaagttggttgaaggactaagaatccaaagtgaaaaaaataagcccagggaagaatttcctacctccccgtcttcattcctagtacctactcaaaccaaagactactagccttgatttcccctctggggtgctgcacacttttgccaatccccaaacaaagacagaaacttcaaattgcttgttcgtgcaagatcagaatcctgatgttatctccttactgatgttaaatacaaatctcatttagttctgatctttgttttaatgtctgaatttgactttggaagtccagttctcatagaggcgagtcttttgagttatgacctggaattggcatccaaactgcactctttgctcctattattcaaggaattatttggattgaatcttgactgtgttagttgcttatcttaatcatgtcaataatgattttctgggattttaaagaaaatctacagaatttaaaaatctatagattttaaagaaaatctatggaatggtttcctaaagggacaaaaatttatcatttgggctttccttgggattcagcagacaatttagttgattccattttgaagaaaatggtacacttgactttgagacactggtccctgccatggtcctcttgatgtgggtcagaatccctgctttttatctttaacaaatactggccaagaatctgcaatgcattacaccccattccaggaaatgggcctacaacaataaacaaaacaaattcttgtggtcatgaagctgacatacttgcttctgttgtagactctgctcagctcagggcagatagccttcagacactgtagccaaagaaggaaccacagtgaagcttacaaaggttgtgctcctggggtgctcctggccagtgtctccagtgcttccttattactaccaggccccattgggagctcttggggagaggccatatcaaccaattccaagcccagctttaataataataattacaataatgacaactaacttttactaagagcttacaatgtgctaagcagagagtgctctccatagatacatctcactgaagcctcacaacaattctttgaagcatttgctattgtgggctccattttacggacggggaaaacaaaatttgagagatgatgtaacctgccctaattctttcagtggcagagcaagcatttgaaaggtctgtccagcttgatagcccttgttcttgatcactgtgaactcgtgtctcctaattataagagccagaaaagggagagcccatactgaagcccaagttcaagacgtttaaaggcaacaaccagaacatatggtgtgcctgcttccttaagaagggctgagggacagtcaagcccgtgagcagtaagaaaaactgttttgaagtctcagtttcttaaatgactaaattcaatttgattcaacaacagcaagatgctaataatctgccattgtatctttttaactatttgtgctcaaataaagggaacagaaaatgtcttggagagtaatgtaggcatccacattcctaacacttcagataggacattaggtgaaaatctggcaggaaataaaattggctcagtgtcagtatttctgacataactgtatacctggatttcttctttaacaatctcctcgttgttctgaatgtcacttaatccattagaatcctgccccttcaagggaattgaccccactggccaatttcatgcttgccccagcttttatgtagcactgggtgtcaggacccttgacttaatgctatcaaccatccttccattggggttgtcattttggtacttaagggaaatttcccatgcaaaggtcaggttggttgttgataacttaggtcctattaataccctatgttgtcttcagccttgttttccagggtatcaactaagggatcaggccaaaagtgtgaggtataggcccaagccaaacatttaagaaagcttgcctttaggctattgtggccttccccaaccacttccttgtgagaagtaatgcccctagaatattttcctttaattttcacaaaaaataatttttttaaaaaaatggaatatctctgctatatgagtctctctgttgctgggacttagagaggaggggaaagaaggaggagtccaagaaaccagtttcctctttctgaatgtgagaaccctgttgccacttggtcatggtcatgaggctgcagggagtgtaactatggaggtgagtgaaagctagtgttgatgtttaaaactgaagattgaatacttcatggaagtgacttttcctgctgtagtacaagagggaaatagtcttctgaccctaggggctgcttaacaactttagggtcaacaccattagtgtctatctcagtgttttctcctctatagctaaaggatccagaagaaaggaaaccagagtgagagatgtggggtcttaacagacatgtcagaaataagccccacttaccttttgccaaatggaaaataatcatctctccaatggagaagggtctcctccttgttctcttcccacttacacagggacctttgggcataattccacccacaggctgagacggggaaggcagctgttaagggttgtctccttgacaatatcttcagctccccctgaagcatttctggatcagagctatactctgactgagcaatggatccctaccataagtttaggattagctggaggcaagatgctacatacatgctacattatgtaggtgctaaggtgtacccttctttctgtccaggcaggtataaagaagttgagcatcttggggtaatggaaagatcatggggtttgagtttaatacacctgggtcagatttccaagtctacaatttactaccagggtgggcttgagcaatatctttaacttctctgagtcttcattcaatcctcacaagcaaccctttgaggtagatgttaatattatacccactgtagatgaggaaaagaaggcccagagaagttaatcaactagcccaggggtcacacagccagtaagtagcagagtaggaattcaagcatagatctgtctttctgactcagctgcccatgcgctgaacaattccactttgttacctcagtgatcttggggccagcaacccagactgcacttgtaggcacattttgaagcacagctcctgacatggctccagacacaactccaggaaccttactcctaggtttaggcagagttctggaaatatgggatctctgtgtaagagagagagaaaaaaacttgaggattggtatgccagcacataaacagtggaatgttgctgccaaaataattattcttatggtgtgttaagagaagtgaatataggccaggcacggtggctcgcgcatgtaatcccagcactttgagaggccaaggcgggagggttgcttgggcccaggagtttgagaccagcctgggcaacatggtgaaaccctgtctccacaaaaagtaccaaaaaatcatccaggcgttacaggcctgtagtgccagctactcgggaagctgagcctgggaagttgagtctgcagtgagccatgatcatgccactgcactccagcctaggtgacagagtgagacctgtctcaaaaaaaaaaaaaaagaagtgaatatggcaatactaatcaacactgtgtgccaggtaataggcacattatatatttatacattctgtcactcaaggcttacaacagccctgtgggggtaggatcagctgagaagcagaaccaagttcccactccttttaattttggcagggttagagtagggaacagaagagaagtagtccaattagacactgatgctcgagtccactattacctgctgaggtctgcctctctggggatccatagaaggaaacattttacttgctgatctttcaggctcaggacccaacatgaagatgctatcatgggatagggctttgctccccatgctgctcttggccctggacagaaaggaaaggtcttgtaaaagcaacccaagggccatgggaactgaagacaaatgtatattcataatatggcctaccatagatacctcagaaggagagcagggatgcatatgtgctgacatagaaagtggttcatgagatagtaagtgaaaaagataatagtatggtcccatttaatatatacacacatatatagttcatattcaaagaaaaaagtctagaaggatatccacaaattgttagaggtggttccctctgaggaatggcgcactagggacaggaatgaaattttcattttctacttcatgtccttctgtataattttaatttttacattatgagcatatatcctttttacataacagtcttactgagatatagtttacatgccatacattttgcccatttaaagtatataattcaatagtggcaattccggggaatgggaggaaaggccatgagttttgttattattacagtgagaattataaaagatctttcacatccaaatttctctcgtgtttttgttttgatttaaaaaaaatcaaagatcttcacagatacacaaggctttaattcatcagatcctttcctctttcacacaagagctctacaatatatctatcctattttcaaagtcatcctatgtaccacctgcacctcccttccccaagcttgctaaatccagatgaaaataccttctgattgggaatggtgccaggttgatgataattacatgttaagaaaaatcagaagaaagataaaaacaaatgaaaggctaaagacatgaaagactcctttttggagtgtggtaatgtattttacctttaaaaaatttcaaccaaagacatcacaggaagagcaaactacagaccaatatctcttatgaatatagacacaaaaatcctcaataacacactcacgaactgaatccaacagcatataaaaagaattgtataccatgacaaagtaggatttacaaggaatgattggcttaatgtatgaaaatcagtgaatgccaaacactgtatcaatagaataaaaacaaaaactatatgaccatttcaatagatgcagaaaaaacatttgtaaaattcaacacccttccatgataaatgcactcaatcttgatagaagatatctgtgacaaaccacggctaacatcatggtgaaggctggatatattccccctaagatcaggaacaagacaaggatgactgcttttatcatttctattcgacactgtatgggagattatagaccgggaaattaggtaagaaaatgaaattaatgccatccagaatggaaaggaagaagtgaaattatctctattcacagatgacataattttgtgtataaaactcttaatgaatacgctaaaaatgactagaatatatgaattcatcaaagttgaaggatgcaagtgtatttctatacacttgcaatgaacaatctgaaaatgaaattaagaaaacacttccctttacaatagcaacaaaagaataaaaacttaaaagtcaatttaacaaaagatgcgcaaaactcataatctgaaaactataagacactgatgagaaaaaatgccaaagtcctgaataaatgaaaggaaatcccatgttcattcattggaagacttaaacttgttaagatggcagtacttcacaaaatgatctacagattcaatgcaatagctattgaatttcatgctggctttttttttttttccagaaaattgatcttaaaattcatagtgaaatgcaagggaccacaaatagccaaaataatcttgaacaagaagaacaaagttggataacttatacttcaatttcaaagcttactataaaactacagtaatcaagacagtgtagcactagcataaagatagacatatagatcaatgaaatagagttgagagttcagaaatgaacctatacatctatggttgattttcagcaagggtgccaagactattcaatgaaaaaagaatagtctcttcaacatatggtgctggagcaactgggtatccacatgcaaaagaattaagttggacctttatctcacaacatatataaaaatactataaagacacatgcacatgtatgtttattgcagcactattcacaatagcaaagacttggaaccaacccaagtgcctatcagtgatagactggataaagaaaatgtggcacatatacaccatggaatactatgcagccataaaaaatgatgagctcatgccctttgcagggacatggatgaagctggaaaccatcattctcagcaaactaacacaggaatagaaaaccaaacaccgcatgttgtcactcataagtgggagctgaacaatgagaacacatcgacatggggggtggtacatcacacactggggcctgttgtggggtggggggctaggggagggatagcattaggagaaatacctaatgtagatgatgggttgatgtgtacagcaaaccaccatggcacatgtatacctatgtaacaaacctgcactttctgcacatgtatcccagaacttaaagtgtaattttaaaaattaactcaaaatggattaaaggcctaaatatgagagctaaaactataaaattcttagaaaaaacataggagtaaatctttgtgatcttggatttggcaatggatttttagatatgacaccagaagctcaagtaacaaaagaaaaaataaatagataaatagtgatatggtttggctctgtgtccccacccaaatttcatgtcaaattgtaatccccacatgtcgagggaggaacttggtggaaggtgattgggtcatgggggcagtttcccccatgctgttctcgtgatagtgagtgtgttctcatgagagccgatggcttaaaagtgtgtggcatccccgcttgcactctctctctactgccaccatgtaagacgtgccttgcttcccctttatcctctgccatgattgaactgtgagtcaattaaacctcttttctttataaattacccagtctcaggtagttctttatagcagtgagaatggactaatacaaatggatttcataaaaattaaaaatgttcgtgcatcaaaggttactaggaagaaaatgaaaagatgacctacgtaatggaagaatatatttgcaaattatatatctgataagtcttggatctgaaacatataaagaactctttcttactaataggaattctttttattgaattcttaaggaattcaataataaaaatttaaataacccaattagaaaataaaaaaagatgtgaatagacatttctccaaacaagaaagatatacaaatatattttccaaagatatataaatggccaacaagtacatgaaaagatgctcaacatcaccagttggcagggaaatacaactcaaaaccataatgagatgccatttcacacccactagaatggctagaatgaaaaattcaattcagataataacacgcattggcaaggttgtggagaaattggaacacccatacactgctggtggtgcccccatacattgctggtgttaaagtggtccagccactttggaaaacagtctagcagtgcctcaaaaggttaaatatataacggccatttgacccaacaattccactcctaggtatatatcccagagaaataaaaacatatatctgccccaaaacttatacacaaatgttcacagcagtattattcacaatagccaaaaggtggaaacaacccaaatatccattaactgatgaatggataaaatgtggtatagtcatgcaatggacagtcagtagcaaaaaggatgaaattctgatacatgctacaacatgaatgaaccttgaaaacattataatgagtacaagaagtcaataagaaaagaccagcttccactcatgtgaaatgtccagaataggtaaatccacagagacagaaagcagattaatgatttctagggcctggcgggcgttgggggaaggttgaatagggaggactggtcaatgggtacaggagtttatttttgaggtgatgaaaaagttccaaaatttattatgatgatgattgtacaactctgtggatttacaaaaaacgttgaattttaccgtttaagtggtttaattgtataatatatgaattatatctcaataaaactgctaccaaaaaagaaatcaagttcttgatgcatgattttaaataaatgacccttgaaaacatagtaagtgaaaggaagccagtcaaaaatagccacatattgtataattcattcatgggaaatgttcccaataggcaaatccatagaggcagaaagcagatcagtggtttgaaagaggataggggaatggagaatgactgctactgggcgcagggtttctttttagggtgacaaaatgtcctaaaattgggtaatagtgatagctgcacatgctaaaaggtagaactttgtagtatgtgaattatatttcaagaaagctgttatatagaaacataaaaattttaaatgataaaagttattcctgttaggtaggagaaaatgtgtatgtttatataaaagatgagattagacacgaaaaaataaaggaagaaaagaagaaaaaagcaagtaagctgatacatgctacaacatgaatgactcttgaaaacatgctaagtgaaaacatactaagtgaaacaacctttgtatgattccacttacatgaaatatccagaataagaaaatttatagaggcagaaagtagattagtggttatttaggggggaacctgttaattggtacagggtttcttttagggaggggtagcaatgtttaaaaacagataaaataaactttaaaatgtttaaatgccctttttgtacttattatctttattacaaaacaatacatttatgttagcacttaaaaaaaatcttcaaatggtaactagagtagcagcttgggcattgtggggctagcacctgccctgtcattatgagcctgtggggacttcatatggatatatttgataatgacacactataaggacaatctcatgttatggggattaaaacagaacccgctctaagatggcttgtgggccaacaggagaggagaggagagagatgtctgctgctttttactaaactcctacttaccttttccctataaaactctgctatccaggtggccctggtgttggaagcaacgtagtctgctttataaaacagcagtccagcagaaaattactgtgactctctagataaacacttaatggatatatatatgattgatccagcattgagaatgtaatgtttccagacatctctatatacacgcatacgctcagtatgcacatataacacgctttcattcactgctgctctatgatctactggctcaaatcaggttcagaaccagtgtagcatctgtgactaccttgcctcctctgctttttgcagaaaaagtgagaggaaatcttgggctatgagtgggcttagaaatgtctctcatttccatgctgtgcattaaccaaagtgaaatggttgaattggctctatagtgccaagccctccctgatcaaaagattaaattagcaccagttgtggccaagtctgtcagaaatgaaaactcttgtccacttaacatatcttgtgctcattgatctgttccctggaggcgaaaataaaaataaaaataaaaactcccaaacaaaatctcagccttaattaagggcagtgaagtatattattacaacagcactcattaagaaatcaaatgaaggaacgggatttgtccattccatcagatacggcttaatacagtcttggaaatagatgctggtcctatggtacaggccaggggaaggctggtcataagtttcgttatgactaattgcttcagtgaatgaaaaaagctgatctcccttctccggagtgacattttccagggtttcttcccctagcacattaagcagaagactgagaccaggggtgatcttcaggccccctaagttatattatttgaatttccttgcacacaaaaaaatcccccccttctctctctctctctctctcaggttcacatgtgcacacacttctggaaaggaaggaacaagtaaaagggagaaatgtagaactttagcagagatagtaaacctgaatgcccctccctgacctccccctgggttttagcagggctagtcttagtcttactgaacactgcaaggcaatgggctataatagtattacttgtgaggtactacataagcccctctttcaaaaccgtctgccctactcccagcaagactacttgaaattccttacactggatgcactcatgaaggttgttcttaaggagccatatatgataactatcaggccattatgttatagaatgtattgggggagatattggggacagtataacatgtcagctaactgcctcattccctcaaggctttgcctggttggagcgggcagcaggactggtgagctctgtggggagtccagataagtctggcatttaaggccagaagaacaggcctaagcagaacttcatagagggggatctgattgatccagagacagctgggaatcctaggtgtccagatagcacaataggatgtggaaatttgggcactgcagatgaatatctgaacagcggtggcagtggtagctggaaacagtcttccccatgccccctgtgactatagcatttcccctagtctcctgaaatggagggagaaagggatctgggctgtttgcttgcatgtgtgtttttacagcaacacagtgatctcatgctcatgacccaccccactcccagctagatagctttactataggaggctttcatcacttgttatgagatcttggctagatcggtagtctgagagccaggcaagcaaaccagaccaagcctcctgaatgacgtaggcccttcttaccagatcaaacaggccttcagctcctcattggctgcaggccccacatctcaagttattttagttgcgacaggcagggcttccctgaatatctgcaccctcttattcagtgctctcgggaagtggggtatgcatttgccatgctccaacccactgagatgtgcagctcagacaacaaacatgcatatgcacacagagaaaagcaccacccccctcccccggacatgactgcattggcaatggctgcaagcctggcccccacaggtggggactcttggtgtccctggtgatttggctgccgaaaggtgacctagatccaactgcctgcctcttcccctgtccccatcactctccaccgcatctgagctcacctggccttagttggttgattttcccgaacgggctgcagagaagagatgttaatgttgctgctggacaagctcagttctagcatttcttcttcctgggtatcttcggcttctttttccttcttcttaacaaaaaagctcttaagggctttaaatttgcatttcttctttcctggaagtgaaaaatgaaaatgaggcagagtgtgatggtagaagggaagacaggagaggaaaaagagccttcatgagaggaaagaggaccatgatcccacccaggtgtcctgcagagcttggactcaaccccaatgctgacagcacccttcaacattcatttgattagtcgtccccttaataactcagtaacaaagtgtctgagttactggtaaaagcagaagcccaggccacagcttgtcatctctgggcagctgctattcaggccaaactcactaggaattcacttgcctctcaatttcagctattaacatatacacctctttctttgtcctaagaagttcattcatgtgaagcaatgattgaggcaatgaaagcacttagtactcccctgactctaccccagtggctggagtcattgcaatccaataggagagccaagctcccacatgtgaaaaacacttcagaacccttagaaatccaagtctaagtggcagttgatacttcctagcctgcgtgctcaaaggatgcagacccaaagagtgagtgcggttggttagtgcagtccaggaacacttccttgaggaaggaatttatgagcaagggagatggccgggaatcagaaagaagaaagggctgcccaggcaaagaagctgcctgtgtaaaaggcatgtcaaaatcagataccaaagagtttttcaaggagtgtgtgtgtgtgtgtgtgtgtgatgatgatcattgtgtgtgttcttcaagtcttgccaattggtttggattatctacagggctgctgccctttgcacatgcagataaatgagagtttgctctatctataataattaccagggcagcagtgaggagtgtgagttttaaatgcccttaaggtgctgtctgtttgggctttactttttttttttttttttgagacagagcctcactctatcacccaggctggagtgtgatggcatgatcacggcccactgcaacttccacctcctgggctcaagccatcctcgcaccttgcaccttgcacctcagtcccaccccagtagctgggactataagcacgcaccaccacacgtggctaatttttggattttttgtagagacgacgctctagaaactagagttgagttctagaactagagttgagttctagtctcaaacgcgaactcttgggctcaagtgatccacccgccttggcctcccaaagtgctacaattacaggcatgagccaccacgccgggcctctttagtttcttaataagcacatatgtctttattgtgcttattaagaaactaaaggggagaagggggagagggctcgtgctgcattcttcaaagggaaggaattagctcttattgatttcacatgcaacaagtgccaactaagttgtctcattccaagtctcaactgtctggtctccagaaggtctcatcagcacagcaattctgtgctggcaatgaagggtccagacaagggagttgccaatgcagcagccatcatgaaaggcttaatggtgtaatggaaagcaccatccaagagtcagaaaattctggaatcctaggcttgaattcactatcaattagctctgtgacctggagtaggtcactcaacctctctgggactcagcaggaaaattaaagaattgcacctgatcagcatctcccaaagtgtgttcagagggatgctcataagatttgttgtatgagaaagggatccgtagtccagtcaatctggaaaattctggattagacaaagttcagtagcctgcttttcaacaaaacttttctgaaacttcaaaatggttatgtatatggtgaagttccaagaaaccaggcaacaatattatctcccaatgtatgtaagcggaatgtctggcaaaaaacactttgagaaatgctgaactagagttcctttagctttgaaatgctatgacttatttgtgcaccgattactcctgagcctgccagggtaaaggttcctaaacttcaaggcctgccttaagtccagtttcccaccaatcagtgaaactcatgcttctctctatcttctgaacacctaaaacttggctgttagcatcaaaagttttgcatctgaatgttcttagcctcctcactcattcattcgttcattcatctattcaacaaatatttattaaggtcaagtacttaccatgttctgggtatccgtgagaaagaaagaagttatagctccctatgtcttagctaccgcccctacatcaaggctgtaggcaagccctccttagcatcccccttagcaactagcacagtgcaaggcatgcagtaacagctgtgtccactggggagcgcagaataccaacacagcttgtcacttcctttgacttgagaccactgaacagagtcatccttcagcatacgataatttaaacactggcccttataaggagttgatgcaaattatagatgacataggtaaagagcttagcatatgatctggcatgtagtaagtgttcaataaatgtgagctagtgttagggactcagtaattacttgtttatcagggctggattcaattctatctcattagaagcagccccatatctataactgaatagtgaactgtacaatatgcataattggaggcagaagccagcatggagtagagcaacgaaagattatagaactgtttgcttgataattgctgcttaagtaatttctgttttggatgacttgggcaatttcttatctactagaatttgcctatataggggcatggttgggaaaacttggcaattctacctaaagagagaaagaataaaaaatgaaaatgaaataggaaacgtatattttctgcaagatcccttttaaaagtgttttcagaaaaaaataatttctacaataataaaatatttaaggctgggcatggtggctcacacctgtaatcccagcactttgggaagccaaggcaggaggattgcttgagctcaggagttcgagaccagcc[328 bp omitted]aaaaaaaaaaaaaaagaaagaaagaaaagaaaagaaaaattagctgggggtggtggttagtgcctgcactcccagctactcaggaggctgaaacagggggattgcttgagcccaggaggttgaagctgcagtgagctatgacaatgccactgtactctcccctgggcaaggaagtgagatccttctacctctgcctcccaaggtgccaggattacaggtatgagctactgtgcccagacgatttattgattcttgacaggtggatctcattctggccttctgaaaggggaacaactttatgctcagaagatttagaaacacagcaattgttgcccctcttgcttcaaaatcccatagtggaagagaggaaagcaaagctaggattccctagcaattcctgagttgcaaacctgcttctaataatccagcaaagacagggagaagagagtcagcagctaatagccatttgtgacacaatctataaacactgactaactggataaaaacatgtctaataaactatttaggctgtaataatgaattcaacaaacaatcattgtatgagcagaaaaattgtacattaacacatttttatgttcctaaattaacaaaatgactagtgactttggaactgtaacaggtgctgaaagttaagtatgcatatagtccaatttccccccaattttccattcttttctgggcagaaacaacttattttcccgcaaagattcaaaaatagctaaagcaatgggtgtctcttttaaccatggaccctagaagaaaaagaatgtttccattccatcctgtagtgtggctctgagtgtggtggtggtatagctttgttagcagggagctggggagacacggagagatggtaactgccaaatatggtaggttggctgctgttgctctaggtcagtggcttgaaagctggatacggcctttgtgacaacccattgccagacatacaatgtcagtagcaagggtctatgtcttcagcctgctttccattaggagaccgccctatccctaactgtatccaacaccccccacccccactatcccatgaatgaagacgagccctggtctcagccctgggagtgagatacaaagctgggtactgtccatgtgctatgttgcttttgaaaccctaatggaatctgagatggttgccatatattcaagtctataaatttggcctttgaagctttcttttttaaagtgtggtgggggcacctttcaatcaccagcagctaagccctccacaggctgtttttcaaaatctaggaaaagcacaaagagtagagagatctagacagcaggtatgggtaaaaactcacatttgtacccagcaatgtttatatgggtcacctatacactggataacttatgccatcacagggtacagcagttgcagtcagtgagctgacagctgagagctgacagctgtctggacttctataacaaagccactgatttccctgtctcagcccaaagactatgcattcccaagcagcaagtaactttcaacatactcatccagtcatggtctgcagtgtgtcacatgccagaaaacagctcattgaaggctgttttttctccagggaagaaaacacagctaaatctaatgagaaatggttgcctctaagttgtatatttgcttatccacaatgcatacaggcagcccatctgaattgaaatgaatgagcttttaaaatacatcgcataatgatgactttgttcttttgcattgctgcttggaaagaaatttatttttttagtttttatttattattttttttttttgagacggagtctcgcactgtcacccaggctagagtgcagtgatgcaatctcggctcactgcaacctccacctcccgggttcacgccattcttctgcctcagcctcccaagaagctgggactacaggcatccgccaccacgcccagctaattttttgtatttttaatagagacagggtttcaccgtgttagacaggatggtctcctgacctcgtgatctgcccgcctaggcctcccaacgtgctgggattacaggcgtgagccagcgcgcccggcattttttttttttttttttttttgagatggagtcttgctctgtagcccaggctggagtacagtggcgcgatctcagcttgctgcaacttccacctcccagtttcaagtgattcttttgcctcagcctcccgagtagctggaactacagacgcctgcaaccacacctggctaatttttaaaaatatttttagtagagacagggtttcaccgtgttgaccaggctggtcttgaactcctgacctcaagtgatccagccacctcggcctcccaaagtgctgagattacaggcgtgagccaccacgcccagctggaaagaaaacatttctaactaaactttcttccctttaacctcccaacagccaccttattctctggccagccctgactagttctaaaacttctaaaactgtactcaaatatttggtcttacaaaaaacaaacttgagaacagagaaaaggcatttcgttgctaccactcttcatcaagatatcctgtgctgccaccttcttttataggcatctgtttagttcatatccaaaaagtcaattggtttggtagttgggtttgctttggtgagaaggcctttcactcatttattcattcattcattcattaaatattttggagtgcctaatctctttctctctttttctctctgtctctctctctctctgagacacaatactaaacagtgataacacagagatgaagaagacccaagcactgccattaagaatctgtgatcaggctctcagcatcccctgccccacatcatgtgtgaagccaggcccccaggaagccacaaggaggtttccctctgttcttccagacaaagttttctgtaccatacaccactaaagaaaactcagcaaaagaatggaagaacaacccaaagaactgttcaattcaattctgtctttacactcaatgtctcacattgcatcttatgatttcctttttattgtgtgtgtgtgtgtaaagcttatcattgtttagtgacatttgcctccctttctaattattccatgcatgatcacctatcactcatagattgtgccacaatttaggcaatggatacacgagtaagttttgccaaagagaatttttgtaaatttaatcctatttaacagaagcctgtggaggcatcttttgtttctacctccttttactcctcaacaaattaatctctttcttagatctgaattactatctacagcaaaacctcagctgaatttgtcagatcatggtctgttctgattggttttttctgatgaagcagaaaaagccttagtaagtaaaacctggtaaccattttcaaagaagattgcaggacctcaggcaaatctttgactatcagagttggaggtgccaaagaagaaattagaaaactgaaaagtaaacgtgactgagtctaatgatctgaacttgttttcttgtgccttgcttctttgtcctaggagctaaataaacacagtaaacaaatctaattctggttatcaaagttttattgggttacttaccctcatcaccggcctccagaacatccagactgtcagaaatttcacttagtgattcagccattgtaggatgactaaaataaaatacaaagcaaaaaagcaaaatatcatcatttgatattcagggcgtaatgcaatcctttcaccctaccccttatccttcagttatattcttaaaatagcctagaaaaaatatacaaatggaattgccattacagagaattatccttcctttaaaaaagacaatgattccaaatgattccatttacataaaatgtccagaataggcaaatacgtagacacagagaatgtcttgctcagggctgggaggatgttttttgttttgttttgttttggtggggggggcgttggtaaagtgtacaagatttcttttttgttttgtttttttgtttgcttgttttttgttttttgtttttttacaggatcttgctctgttactcaggctggagtgcagtggtgtgatcgcagcttactgcagcctcaacctcccaggctcaggcaaaactctcacctcagtctcccaagtagttgggactacaggcgcatgccacaacacccaactaatttttgaatttttagtacggacagggtcttgctatgttgaactagaactcctgagctcaagcaattctcctgccttggcgtcccaaagtcctgggattacaggcatgagccactgtgcccagataaggtttctttttgagatgatgaaaatgttctaaaattgatcgtggtgatggttgcacaaatctgtgactgtatttaaaaccattgaattgtatactttaaataggtgacttgtatagtatgtgaattatagctcaataaagctgttaccaaaaaaagacaaatgcaaaaaacctgatctattgttttgtgggttggggcccattaactctggatgcctattactattcacgggtgtgcccagggagacaaaattgttttgataaacacacagagccataaagaaaagactgaaacatctgactacatgaaaatttcaggccgggtacagtggctcaagcctgtaatcccagcactttgggaggcaaaggcaggaggatcacttgagcccaggagttttgagttgaggctgggcaatatggcaaaacctcatctctacaaaaattttttttaatagctgggcattgtggcatgtgcctgtagtcccagctactagggaggctgaggcgggaggatcacttgaacccaggagattgaggccgtagtcagccatgatcatgccactgcactgtagcctgagtgacagagcaggaccctgtctcaaaaaaaaaaaaaagtgaaacttatggagaagaaataagtcaataaaagaatgacaaactagaaaacaatactagcaacaaatataacagatacaggggccaaatttcttaatttataaagagctcatataaatcaataaaagacaaacaacttggtctaaaagggacaaagactacaaagcagttagcagaaaaagaaatacaaataatcacatatgaagaggctccatcccactgacaattaaagagatagaaataaacatatcaaataagtattgtcatctatcagattgtcaaaatccttaatttggatgatattacattgctgacgaaggtgggaaaaaatagggactctcatgcactctggagtgagtagttctaactctctaaagagcaatttggcaatacctatcaaaatttaaaatgcacataccttttgatccaggaacatcacttctcgaacattaccttatagataaatagtcacacttgcacacaataatatacatacaagaatgtgtatcacagcattgtttccaatagttaaaaacgggaaacaaccaaagtgatcatgaaaaggatagttctcccatgactcactccatgtcatgcttctaaggaagcatgtcggttgataatcaaacttttagaaatcaatgctgacattatttttagagacagcgccttgctctgttgcccaggctggagtgcagtggtgcaatcatagttcactgcagcctcaacctccttggctgaagagatcctcccacctcagccttcatagcagctgggagtacaggcgtgctccaccatgcccagctaatacatatatatatatatatatatatttttttttttttttttttggagagatggggtctcactctgtgcccaggctagtcttgaactcaagtgattcccctgccttggcctcccaaagtgctgggattacaggcatgagccactgtgcctgtcccaatgctttcattcttgatgaaagtttgtgtggggggtgggggtggggtgggagggagatctgaggagcaccacaacccagagaaagggtgctatagtcatctgtgccagaaggccatagaaaggcaagcagagactttgtgcctatgataactctccttgaggtcttgatgtaactgaatgaactattgtaaagtggggttaagtagattctggaatccccttgccactccagatctgctcttttcccagacatagctatgctgccattgctgtttcatgggtgggcttcaggcccatcctgtcctgctttctagctgtaaacccctgatgtatctccagaggtggggggccggggggcggggctggtgaccacaggctctaaggctaaggagaacttgagagttcacatagccagagtgactgaagccttggagtgcaaaaggttccaaatcaccatgagaactgacagggctgtggtgtcaagattgcttcagacccacttactgagatgccctgtggttccccacaattccccctcactgccacaggtaataaacccaatttgttcaacgacaggtatgttcctggctgaaaggtattgatattttaagtcactcaacttttatgagttaatattacaattctgcctaaagatgacttgagtcccaggcccacacagtgatcaataattaccccgctcacacacacatggagacacatgcacacacacaccctctccactccaataaccataccgcctttcttatcatatgcagaccatcaggagagcccacatcaatggatttacacaccaatgcattgtcccagaatgaatggctttacccttggcattcctgtctctgctagttttccaagatctggagatctggcaggagcaaagaggaaggaaaattcaacatctgactggacacagtggctcacacctgtaatcccaacaatttggaaggccaaggtgggtggattgcttgagcccagggctttgagaccagcctgggcaacatggcaaaaccccatctctagaaaaaatacaaaacaaattagctgaatgtggtggtgcatgcctgtagtcccagctactcaggaagctgaggtgagaggatcacttgagcctgggaggtcgagggtacagtgagccaagatcatgccactgcactccagccagggtgacagggtgagaacctgtctcaaaaaaaaaaaaaaatattcaaaagctcttaggaaattcagagggagaacaggaggagtttgtgtcattggtaagttcctggccatcttaataaacacagcagcacccccacccctgccactttagaagcctttttagacattggggaaataaactatcttagagaagcctgtgggaaaaaaagcccgttaaccacaatgtggggccatggtaggctaacattgtcattgacctaccactgtcaagtgtagaagatagaaagggaaaaaaaaaacactaaagagaaaaatatgaaagatgagggagaacaaagaaagagggcatcttggctacatctgaacttttagagcactaatagaatcattgcatttaacccttgagcttagactgtcctgtctgaaattctttgtagcatacttgccttatttccctaaccaaatcctaaaagccctgaggcttttagcaggcactctgttgacaacaccaccatcaaccaatccagctggacatgtggaactgtctcctctcctaaacaacccagcaactacagcaaaacacaaatctccccttgagttcaaattctcttcctgttaccatcccattcctctgcatctctttaaagtaaaattctttaaagagttatctatacttactgcctttatgtcctcactttctattctcgtgagctctccaatcaggcttccaaactgaactgcttccaagccagtccaccaacactgcgcttgctgaatccaccagttcctttaactttcagcagcatctgacgtgattggccacgcccttctttttgaataattttatcacttgtcttctggaacaccacactcccttaattttcctcctaccttattggctgttccttctgggtcgcctttgctggatctctctcctctccctgattttgaaatgtagcactgcagggctctgtccttggctctcttctttgtctacaatcacttcctagaacctcaccattaaatagaaaagttaacctgagcagaattgcaagccacgtattttcaattttctagtagctacatttttaacaagaaaaaagaaacaggtgagactgcttttaataatatattttatttaacccaatataaccaccatattatgattatttcaacatatagtcactacaaaaataatattaatagtatattttacattatttttgttcacagtaagctgccacatcagctgcatcagcctcctgctccaaatccccagtggcttcccatcaagctgagagtaaaatcccagccccttaccatgggccttatgtgatgcaagcccacccccatgctccactgatcaccaaacccgctacccccctacttcatcccttcacctagcctcactggccctcctggtaatgccccctttcaatctcaggatctttgcatttgctgctttctctgcctggaggactctttccccacatagttgcatggctggctttcttgcatcattcaagcatccaatgttacttcccccagagagcacgtccatgatcatcctagttaaaatgctcccactctctctccatcccattattctttttttatttattttttatttttcatttattttttgagatggagtttcactctttatgcccaggctggagtgcaatggcgcaatcttggctcactgcaacctccgccacccgggttcaagtaactctcctgcctcagcctcccaagtagctgggattacagacgtgacacaccactccctgctaattgtgtatttttagtagagacggggtttctccatgttggtcaggctggtctcaaactcccgacctcaggtgatctgcccacctcggccccccaaagtgctgggattactggcgtgagccactgtgccaggccaattattctttattaacatcttcatagccctcactgctgcctaaaattatattctatgttaattactagttttttgtctatctcctcaactagaatgtaaattccataaggtcaggggccttgtctattttgatcatcattgaatctcccaggacccagaatagtgcctagaatgaaagaggcaaaagatttactgttggatcagatgtggtgtgtcaggggaatagcaggcactcaataaacgtttgttgaatgaatgcataaattcaataaaagaaaaaaaattcttcaattttttattgaaaaattcaataaaatccacctttgtggatttcactctgagcttgatggcaagtcactggggggtttggagcagggggctgatgcagctgatgtggcagcttagtgtgaacaaaaataatgtaaaatatatcattaatattatttttatagtgattatatgttgaaatagtcataatatggtggttatattgggttaagtaaaatatattattaaaataaaaagtggttcctatcaaagaaccacctttgtggtcagaaatttcttcagacacagaggcatgctatacggggcagaggaagacttgtcctagcagaagaacccccttgttttccagtttagcaagacctgtcttccctcccagccctgggttattcacctgtacagaatcaagcactcttggacccctctttcccttgatacacagatcccattcctagatatcctagccacgtgaaccgtgagtgtggagccccattcagctgggctaggtctggaccctcatggagaaagatgtttcaataaaagaaacgctgcctcttcctactttccagccaccaccttttctgtcctttttcccccacaagctgatcttattaaataatttccttcccaagtgtctccttttagaggcatcactgtatatttctttcacgtgcctcattatggctaataaaaatttaaaataaatttgtcccttaatcataccatgattcattggtagtgaccttggggctgcctcctctgagctatacgtttatttatgatatttagaaaaagctacagtcacctcacaatctcaaaaaaggcacagtgttctctctgaaatataaccatgagcctccccgcttaaacttgtccaccagcttcctgctgcctgcaagataaaagccaagttcttaacactcaaggccctctgcaatctggtgttctctgcccactggagggggtccagtctcccagcagcccacccctgactcacagccccatgctctgacctcccagaatcaccatgttcttttgttttctctgtgttccacacaggttgtgcacttggcttggaacatcgtctctctaattcccacatccttgaaattacacatatgcttcaagacccagctcaaaggtaccggccacccatgccccatgctctcagacctttgcgcatacctgttgtcatagttgatatcaccttgagaacagtgaccatgttttgattatctgagtattaccagcacctagcacaataccaggcacgcaggacgtgctcactatatatttttgtggatggatgaatgcagggggtggagagggtcttgcagtggcaaacagaaatcagtgggaaaagtggtcttttttaaacatatggggacacattgagacacactttcagtaaaagacccttctgcatgaagtcccatgaaaaagctggcaaaccgaatgagggaagaggaactatatgtttttatccagtaaattatgagaggctttcggaaccacttccaaggaccaaacatagtcatgtaataatggttatcaggaaacctggcagagcagaggtatcgagtctcgttatcaagtcattattaaagtgctttgtttgcttctctaggccaaccccagatgcttaggccccagagctgccttttccttctgaaactggctcatttgagggttgaacaagggttttgggggaaaaagaggggaaaaaaggggaaaaggcccttcttccaaggttgttgaatttttttaaaccacagcctgatttggcttcagggattcagaagacttttcctgacagctctgttgccctcccggaatggagaatgctaatggaaagcagctggcctcatgttgttggttttctttaaacaatgtaataggatgaaatgtatttcacagagtctgcggtaaacagaattctaagatgacccacaagattcccaccccctggtatgcatgtcctgtaaatcccctctccttcagtgtgggtggacctaacctaatcaggtgggcctctgaaaaggagggtttacatgctctcacttatacgtgggagctaaacattgcgtgcgcatggacataaagatgggaacgacagacactgggcactggggactactagaggggagaggatgggagggagcagcgttgaaaaactacctatagggtactatgctcacttcctgggtgatgggatcaatcatacccaaaacctcagtaacatgcaatttacccatgtaacaaacctacccatgtacccccgaacctaaaataaaagttgaaaaaataaacaaaacacacatttgaacatgagtaaataaaaggaggatttagagatcagataatagaagccagagagatcaaagctgcagcagatgctgtcctgttggccttggagtaaccaactgccatgttgtcgagggccacatggcagggcatggcaggacatgacatgtggcctctagtagctgagagaaccccttagctaacagccatcaagaaaccagggacctcaggcagggcacagtggctcacgcctataatcccagcactttgggaggccgaggcaaaggatcacttgagctcaggagtttgataccagcctgggcaacacaggaagacccgtctctactaaaaatacaaaacgtagccaggcatggtggtgcacacctgtagtcccagttaaggctgaggtgggaggattgattgcgcccatgaggttgaggctgcagtgagctgtgattgctccactctagcctgggtgacagagtgagaccctgcctcagagggggaacaaaaggaaatcaggaacctcagccctatagcctcaaaaaactgaattctgccaacaaccattcagtttaaaagataaccctgtacctcagaggagacctcagccctgacggcgattgagccttgtgagaccctgagcagaggactcagctaagcccagtctggactcttgactcatagaaactgagagatggtatatttgtgttgtcataagacagtattttttttgtcatttgtaacatagcaatagaagactaatagagtcctagaggctctagctctaattgcagatgaagccaaaactggggtaggtttggagccatgtaagctgcaacacagacctggtatagaagcacacgaggggattatatgctcccttcccccagcacaccccactgcaagcacttctttacgaagaacttaagttgctactctctcaagcaaattgtcagctggactgattagaccctgccaaaatgttagaacatgcaaaatccccttaaaggctcagcttgtttgagatggctttccctaccctcaggacaatgtctttaacccctttcaaactattttatttgagacagggtttcactctgttgcccaggctagagtggaatggcataatcatagttcactgtaaccttgaactcctgagctcaagcaagcctcctgcctgagcctcttgagtagctaggacttacaggcatgtgccaccatacccagctaattttttaaaaaacttttcttgttgggggggtcttgctatgttgcccaggctggtctcaaactactgggctcaagcaaccctcctgcctctgcctcccaaagtgctgggattacaggcatgagccactgcacccagcctttcaaactattgctgtactttgtgccctcaaccaagagtatgtgcatccaccaagcagtggctaaagagccctggagttgaacattctgaggtgtggtaaggggagagagtggtggtgattggattcttctagagggagcgtctgatgccaggacgccaactcattgaggaacgaggaaccacccaaaatgaaagtatcagaaagggcccctataccccttaattgcaaaataaagtatcctccaggggaaaggaggctataatcaccccacagcttcctcttttcttgcaggaggttggcaggagggcatcagaggtccagccagctcctgaaatgcagcccttggacactccgtaatgaagatggctgcccttcagatcacacaatgagctccagaagtcctactccacgagtccaccagtagtcagtatgattccattgtggaaagtcaccccactgattggcagagttcatttggtggggtaggggtttgataccaggttccacccaggatacaactacgtccatgcacaaatcagggctgtgggatatagacggaatgattggcatttgcccagcaggggccaagagcagcagcatttctcagcaagcccagggccagctagctagccttgaacttctgtttgtttgtgctcctaggagcaggtgtgagcaccctcacgggaacctgggtagaggaggagaacaatctttttttctttttcttttctttctttttttttttttttaaatactgtgtctcgctctgtcgccaggctggagtgcagtggtggaggagaacaatcttgatggccatttatgctggctctgagagccctgggtgggtatctacccaaagcagaaactgatgcatggctttggtggcacattattatattttttaatttggaaattttgtattgatacattatgtttgtacatatttatggggtacatgtcatactttgttacatgcatagaacatataatcatcaagtcggtatttagtagatattcatcacctcaaatatttgtgttgggaacatttcaagacctcttttgtggctattttgaaatatacaatatattattaattatagtcattctactctgctatggaacattagaactgattctttctatctaactgtatgtttgtattaaccaacctctcttcattcacccctgccacccatacacccttcccagtctctggtaactatcattctactctctaccgccatgagatcaactttttcatcttccacatatgaatgagaacatgtattatttgcctttctgtgcctgccttatttcacttaacataacatcctccaggctcattcacattgctgtgaatgacaggatttaattcttttacatagccaagtagtactccattgtgtatatatactgcatttcctttatccattcatctattgatggacagttagattaatttcacatcttcactactgcgatggcacactacttaaaatgacatcttcagcaaattcggcaaagtcaaccctccaaatgtccatggatgtcagcagcaagacataccagggagagaagatcatctttctacattccacaccctcacctgtgggtatttgaacatctggatcatcaaacagatgcccaaataggctctaggggatgcctgcctcagatacttgctgcaggacaattgtcactgaggcctttcttacacactagaaggccaaagaataatggaatccaccctctccacctcgccatcacgaggaagcccatttcagaaatacctctgagcaccctgattgtcatccagtgaacatgcaaagaacttggcctaaaaggtcctttctgagatctctctagtggcctagaagcctagcagacagggagtcctattccatcttacaatccacaaatcctgtgatcaaaggctctgttcttgtgcagtgaggggcaattaatattatgcaattaatccaactaatgaaattgctgagtcctcagtctgtgccaggcaggcactgtgaaaaattattttatgtgcattatctaattgagtcctcacaagagttctatgtagtaggcattgttattttgtttttattcttttcacacccacttcccagatgaggaaactgagtcttgctgaaattaggcagtctgtgcaaggtcatacacgttgtgagtaatagagttaggactcaaacccagttctggattttaaagcccatgattcgaccactacactcttctccttcctcacttggcaaaatctggtcaatttgaaatgcccactcactgctgccctagagaatcttccttactggtctattacatgacccgaaaatagaatagttcaccaggccattagcagcccccaacacctttgcagatatttgctgacattttaacaatgcacagagtcctgccaaaaatgacccactagatacatatattgtgatgagggatcttaagggagataggtctgcagcatggggacccttgggtggtcagactgaagtgctgttccagcattggggaggaggggcaggaaagcatgagaacactgggagactcaagagaaaagtcagaattgaggggccctaaggatggacttcacagctttgagtgtgtgttgggtgccaagagctctgcccccaaatgctctgctagttctcaagcccatcccagcagaatgtgtctaaggcttttgatcttgttgttgagttactgcagtagctgttattactgcttccagtggtcaataataacaccagttgagggaggaggta[222 bp omitted]gaggcagagaatagcttgaacctgggaggcagaggttgcaatgagccgagattgcgccactgcactccaacctggtgacagagcaagattccatctaaaacaaacaaacaaaaaaaaagtagaagaaagggggttgctagtggaggatgtgaattttacatagctcattggattctgtgggatttgatatagatatctcctgctcttagaattcaaaagccgtcaaggagtggagacaccaggagtcattttctggccaggggaggtaggggagataagggagaaagaacaaccagtcctctgcaatgtgtccccagcccaagctgaactatctgtgtcctttgtgcaggcacattgtaactttctggtttcatcttgcagccttttggcccacagggtggaggttggggaaagcaatctcagcatcaccccatggttatgagaaatagccttttggtctcccagttctggagggatatagaagtctctgagtgaatttcatcttagcaggaagggaatgggcataaggaggggtgatgctgatgtctttgtccccagagggcacatacccacagaaataacaatgccatggccaggtgcagtggctcatgcctgcaatcccagcactttgggaggctgaggccagaggatcacttgagcccaggagttcaagagcagcctgggcaacatggcaagaccccatctctacaaaaaaaaatttctgaaactttagaaaatttctaaaaatattttagaaaagaaataacgcctccaagaatctgagatcactggacattctcagtcaaggtgacatctgagaatttaggacctcagatttctttaaccctgatcccatgtacagccctgcagctcagcagaggcagctccctacctggagttgtgggaagagttatccgaaggttctctagccccaaatctttccttttaccccagccatggcatcaccctctctttctacctggcctaaaatatccaccatcagaatccttccccttgaaccagacagcaaagtcagaacattatttcccagagcctgtctcattagtaaccccaaggtctttatgcacagctactatgtgcttagacctgtttcaggtgctatgtaggcaatgacaaaataaaatcgttaacatttacttgacaatgaatatgtgcaaatgctgtttgaagtgcttcggatacatcatctcatttaatcctcagaacaatcctatgaggtaggtactagttattttcacttctctcccattttgtagatgaggaaacagaaaggctaagtaactgcccaggggcacatgacaagttcgaattctgaaggtaggatttgaatctaggcaatctgactccagagccaataagtgctacagaaaatgaccaattccctgatgacaaagagaaagaatacacatgaaacaattgagaatagaactacattaggaattacaaagcccgcgtcctgaaatctgctgttccaaaaagttgtccttgcagccttgcccgagtcatagcccctctttggacctcagttctcacatttgtaaaataagatgaggcaaaattatcatgtgttaggacaaggattctcagggttaaactctagggcaagcttgtccaacccatggctcctgtgccgcatgcggcccaggatggctttgaatgtggcccaacacaaattcatcaactttcttaaaacattatgagattttttttacaatttttttaagctcatcagctgtagttagtgtattttatgtgtgacccaagacaattcttcttccaatgtggcccagggaagccaaaacatgggccacccctgctctagggcactggctacatgtggaaggagtctgcaggccccaagagttgtggaacaaaaagctggagtgtactttgcttacatgtgtggtacagggggctagatgccagaaatgaggcagaggggtaagatcaagtcagaaaagggtgtccataacacatggcaaagctgagaatggcaaggaacagcaaagcaaggctagtatgctgagatttagatgtaaatgaggtcaaagaacaagggaaggtgaaactgaaggggaacaacataggaggccgtcaagctacagaagggaccagaaggtgcttttatgggtggctccatctacagcagaaaggactaaaagggacatttccatgcaggctgaagtcaccatgaaagactcaatagagaaggcagaagtttggtttggtttggttgtttttttttttttttttttttttttgagatggtgtctcgctctgtcacccaggctggagtgcaatggtgcaatcttggctcactgcaaactccgcctcccgggttcaagcaattctcatgcctcagcttcccgagtagctgggattacaggtgaccaccaccatgcccggctaatttttgtatttttagtagagacggggtttccccatgttggccaggctggtctcgaactcctgacctcaggtgatctgtccgccttggcctccaaaagtgctaggattacaggcatgagccactgcgccaggccgagaaggcggaacttaagatacgccaggtgctaggcagaaaagtttgctgacagcttgagcactgaggcactgagagtcagcacagatgagttacagatgaggacagagagggcaggtgacatccacaaaccctagtgagcaggaaggagtaaatgatgtgcccaggctcttcttcctagagtgtactacctggaaggaaaagaaaagtggcagtgaaccccaggagagcagaaatctgttgggcttctctaaacttcaggcacaagaatccctagtcagaatgacctaggaaaaagaaaaagccacactggagtagcatctgtcctcacagtgcccgggagaagctcctaaatgggggtggcaggtggttggcccctgacccagctggacactgccccgttgtccacttgagcatgagagaaaagcataccccagcatgtgaggaataaatgagatgcatagaaagtagcacagtgcctggcacaaagaaagtgctcaataaatagtgaggtttacaaaactcccatgacagataaaggcaaactgtgagcacagggtttaaggaggaaggctgtaagtcaagagcatgggtaacgatcactgattccttggcactcactcacagggatgctgcttcttcagagggagtggggcccagggacctgcaagtccagaaccttccaggtgactcctgggaggtgagggctccaaatacctagctttaaggaaaccctgctgtaaatcaccttgggtacagggcatggctgaaacagaaaacctgaattgggaagccataagaaatggatggcagctagagagtggattaatagacattggagcctcaggaaagtgggaaggtgggaggggagtggatggtgagaaattacctattgggtacaatgtatactattcgggtgttgggtgcactagaagcctaaacttcaccaagtatccacactatatcactcatataaagctcttggcaagaggcataacacacagtaagcactcgatacatgttcactgttattggtattactctcccttctgcacaagaaggctgtcctccccgtggtggtaatgacctgtgttccctgctcttcatcagtttccctaaagtaggggatgagatgttctgcagttacccacaatatatccatgtaacacaactgcacttgtacctcctacatctataaaaataataaataataaaaagaaatggatggtaggacagggcaagtgtggtgaagaaaaagcaatttgaatgatatctagagagaatcgtgaccacagatgaaggtatttttcttctaataaacacctctaagatgtgagtctccaatgaggcctctagcaatttttggacagttcaaaccccagctctgcaattaactagctgtgaggcctggggcacatggagtcctttcttggagcctccgtttactcccctaaggagtaaggggttgaactagacttgaagtctagggttatttttagctcaggcattcttggattctattatttcctgagatgatctttcaaagttcccagttcatcctagagtagccagattttgcagaggctcactataagccctccctgagtgggccaatggtggcccagccttcacagcaagactttcagaagcctgtcaatattgcagaaaactgtcttactttcagattgtttagaaaccaaagctatatttcccatttaaaaaatgcacaggccgggtgtggtggctcacacctgtaatcccagcaccctgggaggccgaggcaggtggattaactgaggtcaggagttcgagatcagcctggccgacatggtgaaaccccatctctactaaaaatacaaaacttagccgggtgtggtggcatgcggctgtaatcccagctattcaggaggctgaggcaggagaattgcttgaacccgggaggtagagattgcagtgagctgagattgcgccactgcactccagcctgagcgacgacagaacaagactctttcttaaaaaaaaaaaaaaaaaaaaaagcacaggttgcagatttaactaaaaattccctactcattatttcctccacttctaaagagaactacctcatcccaaagagtttcctccttcctctaactctgaagaagcaaacagaagccatttctgtataaaataagtctcaggatcattgatgtttggcttctggggccacaaggacaaaagaaacaaacattcttcacgtgtgaagttaaaattatgtccttcaaaaatagggcatggctgggcatggtggcacatgcctgtagtcccagctactggagatgctaaggcaagaggatcacctgagcccaggagttcaaggccagcctggacaacacagcaagaccccatttttaaaaagggttttggaggtttagtggggatattccccctcctctttccgttaacaggtttctggatacccctccaactatcacaaatgaacagtgaactaatgcagaaacctttgttaatatgcttgatggcaaactctagagaggaagctttccctgatctactgggttctagtgcaaatctgaggaggcagacgcgcccgtgctcccaggaccctttcctttctcccatgggctcagaagactctccctttgacttacttcactctccattttcccaggacagttgggcttatggaaagggaagatctaaatgcagtaaggaagaagtaccatgatccttagttcataggatgggctagttagtacttagctcatgaagttcacaggccaggaaataagaaataaagaccttgttaatgtaaaaatgcaacatgactttatcgaccttctgtagcaatatttttctgaaatacactgcctcctgtgctgttgctcttttcttactcatatctggactttcccaggtccatatctcttcttttcctgttctcttgtttctatttctcattttgaacatctcccttatatgttatagtagataactgaattacattgttctaagtttttgtgtttgtagcaagaaatatggttcaaaatgttcaaattagatgggtaaaatattttgtttctacttttagaagttcaagcaagttgatttaacaatatggggccctttgttaattttttcccctggggccttggcctcattagatgaaactctccctcttcctatcaggctggggaatttttgaggaccagaacctcagactaatgcagatcttgacaagctgagtggcctaaggtaagtcatataatcccttcatgcctcagtttcctgatttataaaatgaacatgataatagaagggtctggggacagaagttaggagatgaaggaagtaggtggaatgaaagaagtatgaacatcataagtcatctttgtgtagtgctcttgactctctgatccagtagtttctaagcagatatgcttttgtcacagaaagagaaatctggcacattgaccttctgagtaggaagcataacataattgtgaaagggttaggctatgacgctggacaaatctaggtttgaatcctagctcttgtcaattactaggtgtgtgatcttgggcaagacactgaactgctgaaaacctaaatttccttagctgataagtggggcttagtactttcatcataggctaactgtgaagattcattcatttaataattgttcattgagctcctgatatgtgctaagaagagcccagagcagtgctcaataaagagaagggccctgctctcacagacagcttggtgaactaactcactgtgtttgtccattttgaattgctacaagggaattgaggctgggtaatttaaaaagaaaagactttgattcggcttatcattctgcagcctgtacaagactaccagcatctgcttctggtgaggacctcaggaagcttctaatcatggcagaagtggagctggtttgtggagattacatggtgaaagaaaggaaggaggtgggcacagtgcctcacacctgtaatcccagcaccttgggaggccgaggtgggtgaatcacctgaggtcaggagttcaagaccagcctggccaacatggtgaaaccccatctctactaaaaatacaaaattaactgggcgtggtggtgcatgcctgtaatcccagctacaggaggctgaggcaggagaatcacttgaacccaggaggcagaggttgcagtgagccgagatcatgccactgcactccagcctgggcagcaaagtgagactccatctcaaaaaaaaaaaaaaaaaaaaaaagaggaaagagaggggaggaggtgccaggctctttttaacaaacagatctcatgtgaaataatagagtgagaactcactcattaccactggtagggcaccaagccattcatgcgggatccattcccatgacccacacacctcccactaggcttcaccttcaacactggggatcaggtttcgacatgggacttggaggggacaagtatctaaactatatcactcatataaagctcttggcatgaggcataacacacagtaagcactcaatacatgttcactattattggtattactctgtcttctccaccagaaggttttcctccccatggtgctaatgacctgtgttccctgctcttcatcagtttcccaaaagtgggggatgagactttctgcagttacccatactctctccatcagcctcccagtaaccagcaggtttgtccaatggttacctgcattgggggctggggcccatgggtgtgtgagggcaaagccaactggatccaacctgtgcccttggcccattagccaccattggatcaataggccacagatacggcttgagtttcaatcccagactcctgggaaaccagctgtccccagaaagcctctctctgggttcacagaatggagtgacttctttgaggcaagtatcaagcccaggtgaggctgctcaggctcctccttaactgtatttgtgaccacccaggccctgtgctttttatatttcacccgaggctattcttaaacagttcagactgctcttttggacactgtagtggcacagcaaggaaaatcctccccctttcctcttctccagaaaggactaaatggctttcctataccaacagcagaaactttcatttcctttggctgtcccagaagaacagaaatgggatcatgactacctaattggttaatggtcactctttgtttgtcaacataaggtgacaagggaactcatatttactgagggcaacctatgtgtgcctgccagttacctaatttaatctttgtgacaacaccatgaggtaggaatcatctccattttacaaatgagaaaattaaggctcagaaaggttaaggcattcacccatggccacatggctagtaagtagcattgtgaggattcaaacccatatttgactccaaagccccatgcactttctactatatggtaccaaaatattttccacgtgtgtacatatgtatctgtcagtccagacactctgcctaagtggctgaaccgttgggaagtatggcctttgatggcacactataagctgctcttctttccacttggaccacatgacttgctccttcattaggagcctgggaggcaggtttgcccatatagtgctctggcttcccagccccaaatgccaagcttcaatgcatccttaaaatggtgcctgggctgtcctgccatacactggtcaggtgaccaacagagcagggcctaacatcgtgaggaactcccggtttcctgctgctctctggtacaaccttcccaattcagacacttacattccaaatttaagacagttttaccaaggcaggacttttgtactgaatctggatgaaagcacagctgtgtaatgtgcaaacttttggcacaaaccttatgcttccagagggacttgtactcttcagagcacaacccaacaatgctgtagcatagacagctaggggagaagcactactatgattaccattttattattcccactttacagatgtggccaaagaggcatggggacatgactagaggaatcctgtgagggctgagagttggagctctgcctctgaagtggcctttaaatagtattccaggggaggtcttctttttaagccctgcacaagccccacttacatgatgacaattactatagttatcacaaatctctagcaataattgctaacatctctcaaattcttactgtgctagatactgctacatgttttatttctcatgcataatttaatttgatactcaccatcctgaaaagtaggtaccattgttacttcttgttttacagatgagaaaactgaggctcagaaggcctagatgacatactcaagaccataaagctagaaagtggtagactgtggacatgaaccaaggactatgctccactagaccatagtgcctctaacactgaatccaataggaaagccactagccacatgtggttgtttaattttaaattacttgcgataaaataaaattaaatactcagttcttcagttatgctagccaccctgcaagggctcagtagccacacgtggctagtggctatctcattggacaccacagatagaggtcatttccattatcacagaaacttcgagtgaacagtgctggtctaaacgctcttaaggtgggtcctcctcagacttctactttgggaaactgttattagtttaaggtagagtctcataatctcggcatgattgacatttggggctgcaaaattctttggtaggaggtagggagtggctcttcctgctcatccttggatgtttagccgcgtccctgggcctctaaccactagatgtcagtagcataccttggccccggttttgacaaccaaaaatgtctccagacattgcccaatgtcccctggggagcaaaattatcccccacatgcccctgccaccctccagttgagggtcaaggtaagtactatacatgcatttgaagtaatagcatgcaacaggggcctgcaacccccaagccacagaccactaccagtctgtagcctgttaggaaccgggccacacagcaggaggtgagtggcaggtgaggtgagcacatccagctgttaagagaacaagtacttaccttgactcagaagtactgggtcaaggcagtactatatatgcatttgaagtaatcaaatggcaagccttcactaacttaacttggccttctgaaagcaagccaattcactaaaactaatttcttctagtgaattataaagtttatagcaatttgaattgaatgggctgttttaatagctcttgaagatttcatgaaagagtaaaaccgtttaaagcagtagaaggagagtaaagatgccaagagggattactataatacattgtaggattcattcctcaaatttgctatccactgactataactatggaattgtgaaggaagcataagaagcagattggtttaaaaagctaaaagaatgctaaagtagaaaatcattaggaaatgacaagggcaatcacatcgcattttacattttggttactaatttccagaaataacacacaacaaaaaattatggtatatgagaaactgatgaaagaattctaaaaatgctaaagttgacacaactgaaaatgcactttcaaaggattcaaaagaagctagtgcacaaaaaataagtatatgaggtgatgggtatgttagttaccttgatttaatcattccacaatgtatacatatatcaaaacatcaggttgtacaccataaatatacacaaatattccattgtcaatcaagaaaatacataaatttctttaaagaaacaaatttaagcattcccatataatatgctgaaattttggctcctgatgaaataatatacttttccagattgttcatatattcccaaggaaaccaaacctccctacaacaagtggaacatcccttagaatgctgctaaagaccaaatgaaacctgtcaactacatctttagagacatctccaaaagctttaaaaccattttctcctaaatgaatttttgcaaagatttaaatactttatgttgtaaataactgaaagaaaaaactttaggtgaactggtaaatacggcaaataatttattcaagaaattgcccaagagccagtttccccctaactccttacagagggtgaggctgggggcctgggagagtatctcctccctctgacccctacactggtacctgccactccattggcacccatcaattctcctatcgctctcatgaatgaaaagtgcaactgagtgaatgcaagttagcaaaatgcgacacccagactgagccccttgccaggaaattagagttaacaatctttcttctaaaactagggggaaagaaaaaaaaaacaggaaagaagggagggagagaaggaagtgaagtgccacagggatctctaatgaccacattaaacacgtctaattacagtgaggagtggaagttgggtctgatctggcaggctaagctgcagctacacatttctggtgctttcaaatggcctaaatttgccttccctaactggaaggtgacatagagccaaatttcatgttcatcattgttctctccgtgcagctaggtatgccgcaaggtctcgggttccggagaactggttgcagatgctatgggaagatgggtccaggttggtagaggacacttcagggttggctgtcctctagcatctggattccagggggctgctcagggccaagaaagaatgcatggatcctcagaataccagcaactggacctcattacaagtcaatatttgtggcttctaatctcaaattgtaacccacactgcttccagggtcatcagggaagttttgcagccaaggggagcaggctgacacataatttacaatagtaattccctggtcaggtgtcaagtacctgttgcagaagctctcagcctcactttcctgaatcctgttcttggagtaggagaagctgactagcatgatgtgaggggcccactatcctggccagatccccaagattaccagcaatcactgcagtgccacaaaagcatccaggtcctgttgaaatacacattatcaggagttaatcattaatgtctactaacctatcatcacaggtcagttggctaagagctagccctgggccacaagatggcaatgtgttagccaagaggaagtccacggcctagaaggccagaggcctggagaagacaggcttggagagaagggcaaagttcaggcccagaacgcctggggtggaaggggtactgaaatcggaaatgggttgtaacaggagagactggggttgctaaaaacaaagttgccctgggctaggcacggtggttcatgcccgtaatcccaggccaaggtgagaggatcacttgagcccaggagtttgagaccagtctgggcaacatagcaagaccctgtctctataaaaagatttttttaaaattagccaggccatggtggtagacacctgtagtcccatctacttgggaggctgaggcaggaggatcacttgagcccaggagttcaaggctgcagggagctatgattgttccactgcactccagcctgggtgacagagtgagagaccctgttcaaaaacaacaacaacaaaaagttgcctgagctcaccattttgccttaggctgaattgacctctgcagcagtcccagagagaggccacagtatcccacaatgtatgcttttggtctactactcagatgacaatctttcctctatctgagctagacagctctgtgctgggagtcagggtactcaggagtctaatctttgtattgccactgactgtatgacccaaagagaatagctaaaaacctctggggcccactttgtttactcttaaagtgaagacattgtcacccaccccacaattacagggtcttgtcagattttaaaagttcttttgctttgccttcatctccttctatacttgtgcaatatggtatcacataatttaagcctactgctattttctcccttcttccaaaaagtgtattcaccaatctcttgataattctcctgtaaactgctgtccttctatctctatgaaaatagtaacagaacttaataactagttatcttgaacaagatctatatctacagtaactagtttggaatttaaaaacccaaactgggtttttaaactagagactcatttgattagagcaaagtgccaatgaggctcttggcatggagtcaaggcccacaagaatatggatggctgctctgaacatacccatttccaccactggccagacatttcaaacatctccacgatgagaaatgtatatatttatacataaaatctagactgcaattgtatgtgggagaggagactgtgaaccaatcctgtgtttctgcccaaatttgaatttcaaggcctattgggcttccttgagaaagtgcaaccctgctgatttggccaagttgtgatcctatgaaacctccttgtgttggggggaggtgggggtgttagggggatggagggtgcgagagtgcccaaggtttacgggggagcagtgagtgtttgagccagcaccatttccctcccagtcttcctctcccacaacacctggagcctaggaaaaagctcaaagaagaggacccgacagttcctccatgtgctcgcttccaagtgctcctactctcatttacattctctcctactgagcttatgtccccatcctctacctcttgcaaactgctgtttactggcctggtcaccccctaagaaggcaagctccttaagtgcatcttcgttcagtcaacaagattctttcaacaaatacttgtgccagacactgtgcttgcttggctccaggaggggaaaggaaaagtttctcccagagggagaaactagctttgtgccgaattgtcagggccaaatgaacccatgcaacgctcagtgattggagacttgcaatgagtgaggtgggtttctggctgtgattccaagttggaatagttaagggaaaagaagagtgttcactccatgattgaaaattggcaataatcatgtacactcacatacccactaattaaccatatgactaaatctattttggttaatatcttcttccttttggaattgcttgcaatacgtaaacatatgcacatacaacatccaaaaacaacactgtggacacataataagaatatactgcttgaatataataccccatcaagtaactgggagactgcatattgtacagcttggaataagtttagaaaattaagacaactcggaaaatttaaggtgattcttctctactcatccatgtttccctctctctttccatccctctctcggccttcctctcgtctctcttccacttcttggccccagtcccccatctcccttatctccctacaagatcatttattgtcagtcatgctagctgcttgctggctgcttactagtgccaaaacatcatgttctgatataattgaaccacattatttgacggaattattgctgtcagttatttgaatggtgttactaatcaatgaaatgagccttgtaaaatccaggtttgtgtggtgctttactttgagatgatgttggctaggtttcttgacacatagagaagctatagctttgtccagtctctctccctggtctgtctgttatataaacatcacccttgtgcagctctcccttctcagacttgagtcatttcttacaaactctgtcaaagtcaaggctgtaggagtgccacaaagtacccctgcaccaagtggtagggaatcgcggtgtgcagggcaggaagccccgggaataactaggtatttccaggtcagtcactgcagctgggccaagctcccccttggtgcttccctccttcttgcctttgtaagtcaaccaaagacaactgcaacagccttgggaatacgctcgacttccaatcctggcccctcggtccctggggcccaggtgagccaggtaggggtgccggccaggaaggagagaagcgtgaaaggcagagaagcctcgaggcgtccagccggccctcatttccccgcgtagagttgacctgtctctgtgtcccccgacctgccgagtcccagaagctgggttgaggactctcccgctgctgagctttcccactcacacgcacacgcacacctgcgcgagctctcccaggagggcaccgcccccaaccagcggggtgcacaggggaatgatgttgcaagttcgagcccagaggtgtctcgctgtcccccgcccacccccgggtcattcctcgccgcccgtttttgcggcgagagcaccatttgggcggttaggagcccctgcaaggccggctggcgttctgccaccctccactctgtggtgtctagggggagtaggtcggctgcgcccgccacttactctgaaatcttgaggcaagcatgaaagctagccatggtgctgctgagggagccgctggccggttacgtgccttgcctgctggggtgcatgggagcccgcgctgtgggcatgcccttagaggctgccacgtgggggcagctcggcacttcaagcgcccacccgcacgcagccccagacccacaggccgaagcaataaccagccagataaagtttcttctccaaggcctctcgctgtcttctgatctcagtccaaaaagggctgggcttgttccttacatggttaggaactgttaactccccttttccctctgtctccatcttcccgccacaacagcatccttagagcaaaataccagatgctctttcttagcctctctgtatccctgcagagctgagcgtgagaagtaatttggagatgaaaccctaaggaaagagtagaggcttttatccgagcaggaaaggacactcaagggctttgggaaggcgatgtaaataaatcgctttctggcattttagatggtgtgggatggagggagaggggagcagaggggagaagagagaggtcagggaagaaagaaaatttaagtagcaaggctgcaagcattcccatctagatgtgaacactgtttttgaggtgttctaagctgttcttgttcagtcttaaggaaaactatttactccctaagccagtctggggccatgaaccaaaaaagcaagaatttccttaaatttgtgaaatcttttctgccctcgagatgaaagtccctaccaaaggttgtgtgtacacggggaaccccaattataacatggcttacattacatggattcagagatgttgcagatcagattgtgtccacagaaaaccaaaagaactggagacagagacaacgagcaaaagtgtgacctaatgttgactgcctggaagacccagtagggcacctttcccaatctcagtcccataaagaggtgtgtgtccctaccttggcctctgagatgcacagatctgaaatattttgattttttaaaagtgcctagtgggagtgcgacacgcaaaacaaatgcagatgcaggcttttggctttttaaaatgacttttgaggaatcaagagtttcaaaagattgtgatttctcctgtgcatgtattcatgaggggcattaaacactgtctagctgggcctaatctgacaggctttccaaattgggtttgtccaaataagaataagaagaaagaagaaatttagctggggtcccttcagggggtcttcgcaagtctggtagcggaggcctgtttttcctttcagtctgaaataggcaacaccctgcttctggaatttcactgggtgggtaggctggggtctctggacagggcagtacatgtgaccctctcttattaactttggggaaaaggaacataactgagcaagaactagatttatgttgcagatgctaaagtctgacctgtggctagaatttctagctagaattcctttctaagtcaaatttgtggttagttctccattattcatatgtggctttgcttacccacttagtacatttcctgtaattgtgtttttaatcaaagaataacttctggaatacctacaccggttgtaatgtcagcaggctgttaagaaagaccaattttaatattggccagaaaagaagctaattagaaaggcaaatctatatcattcccttcccacccaaaaagaacacactttgaaaaacatgagctttggtgtttggataatgcatgctttgtgattctctgcctaactccttccttccattacttcaaataatcagaagtagagagtccacagaaaatccatcttataacccccaaactgcattgatggctccttctactgaaatctcatatcacctgtggtcaaggctctggggtcagagttgtgttcaaattctgactctggttaagtttctgaggtgcggtaactgcattgtgattgtgtaggaaaatgtctttgttcttaggagatacatgctgaagtatttagaaaggaagtgtaatgatatctgcaatttatgctcaattaggtcagaaaaaatgcataggagtgagtttgtgtgtgtgtgtgtgtagtgagagagagagaatgatgaagcaaatgtggtaaaatgttaatagttggtgaatgtaggtgaggcatatacgggtcttcattacagtattcttcaacttacctgtaattctgaagtgttttcaaaataaaaagttgggaatgagatgttagctctgcctgcctttaccaactgccttacagcaaattatttactctcttaaacctgagttcccttggctcaaaagtagagatattaatagaacccatctcaaagggttgttatgaggattaaaatgagataataagtgtgatgcctttagcatagtgcctgtcccttaggaaggtctcaataactgataggaattgctattatcataccattccattccacatcttattatatactgtcttttgttgtcctcgtggtgtttcaaatgcacataacttttctccttaacttagattagaagtctccagaggaaaaaaacacatttcttacattttcttttcttttctttctttcttttttttttttgagatggagtttcactctgtcacccaggtggagtgcagtggtgtgatctccactcactgcaacctctgcctccagggttcaagtgattcttgtgcctcagcctcccaagtaactgggattacaggcatgcaccaccacacccggctaatttttgtattttttgttgggacggagtttcaccatgttggccaggctggtctcgaactcctggcctcaagtgatccacctgccttagcctcccaaagtgcacatttttttcttatatctgcccatggtacagtgctgagtgaatcataggtagtgaataaaacaccttgttgagggactttgtggttactgttctgagggatctgtggtcatagcattgacttgaaaatgaccacatgcccaaaagccagtcattaggacagaccagtagaagaaaatgttagaataacacggtgggagctggataaggctggataagaagacaggactacaaaaacaaaaacaactatttggggaatagttttttttttttttaagctctgggttttggaaagtgttcatcctttgtaaatcccaagagggcatacattccattacttggcattccggatgcgtataacctctactaagaaagttgggcacattcttaagatgctggcccaataacgtagatttccaggtgcagcatagctcagccacttgcttccagcaaaagataaagtacaaacaccatgagtgaatccccccaaaccgcagttcctagataaatgcctccattgctttggggggaatctgatcttcctagctctaagaatgattccagtgagtctaaaacatgcaggataaatttaactgaaaccttcagggctgattcagaaactctaccaggctttttaaacatgcggctctggaaaaatctctataatcggccaggtgcagcagctcatgcctgtaaccccagcactttgggaggctgaggcgggtggatcacttgaggtcaggagttcgagaccagactggccaacatggtgaaacccgctttctactaaaagtacaaaaaattagccaggcatggtggctggcacctgtagtcccaggtgcttgggaggctgaggcatgagaatctcttgaacctgggaggcggaggttgcagtgagcagagattgcactcctgcactccagcctgggtgacagagcaagactccgtctggaaaaaaaaaaaagaaaagaaaagaaaagaaaaaaggaaaatctctataatcagtagatccagaaacggagaatagtgaaacgtccttacttctgaacaggggcaaaccattccagaaggtcgctctcagtctctgtctctcctccccttcctttggctcatgtctccctgctttctctttcccaatcccctcagcccacctcctgaggctcactgaatgagctcccactaaaggctggcaaaggtgtgggtgggtttaagggtgagaaatgagagagacaaagcggtttagtgtctaaatccatgtgaccctgctgattagagcatctcagatggagtgacatctcacgaagcccaggaggctgagttagagatctgagttatggcttctatggagccatttcaccaggcttctcagagtgccttgagaatatctgccctcacaacgctctagggaggctgggggcaagtgggaccaccagatccagagttgtccttaagggagctaggctggaggaaagtacacttggcagggcagggacctcccccagccctcccccaacatttgtaaacaggccaagtctgacataaattcacattatgggcaaaaaagtagggtggaggagagccaacaagatactatggtgggttagggggaggagaggatgccttctagggaggaatgcttacataatgatgcttatataggcatttgctaatggcagttatcagtcctgactacttcttcctccccctcttcccattcctcctcctctcccatcaggcagtattcagagtcattggacatctcttggctggggttggagtagtgggggaggacaaccagaaaagtcaccatgactcaccacactcctggctcgttcttgtagtggaggagatttagaggaagtctgtatagtatagaatgtctacagtacagttttattactttcgggctatatatccaataacacaacacaaacttggctctaggtgtggtcctaggggatctgcctgactgagcagagatgagtggagtttgtaactagacattgcgcaatgtttctaaacacacacctgtccatccacctgcccgcttgtttgcctgtatttcagattgtccccttcaggagtggaaactggaactcagatggggtcaatgatgctatcagtaaaggtgcaaggatgtggaaggcccttgccagtttcttgctggatgccttcatctcctttctcccggctgcacaaaactctaaaataattcgctccactccctccagctctctggtcctcaggagcctgaaaatggaacagtgctcaggaaggaggaggaacccaatttttttccctcacctccagccatggccaaagtcacagtctccaacctgaaaatccccagcagggagaaaacacacacatttatcactcacacttcacttagcccagagcttggaggggtgagacactgcccccacatgcagccttatccaaagcctgcacgcatcccctcccctcaacatcagccaagggagcaagggcccagccaggtatgccacccccattggaggagggacacttgcttggcatagtaaatggcatttttaccatctagccaggcagagaattcttctgccttccttggccaggcagctgagaggaaagcaaccccctgggactggaatcagtgattcacactggcttacccaaacagcctcctgctgtcattttctttccttccttccttccttaatatcctggagaaggagttttcagtacttcctcctgggctgctgacatcctgagctgagtgactggtcaatgggaaaagcagaggcatgtagccagggtacctggcctccaagaacttccccaaaagacaaagaaaaaaaatggctggaaaattctaatggtagacaaggtataaaatgatgaaacatgaaaacccatctctacccttcaccaccaccatgtccctacctacttcttggtttccttccaggaaacaaaagagccgtgtgtgtgcgtgtgtgtgtgtgtgtgtgtgtacctacatgtatgtatatatacacacacatatgtatatatacatatgtatgtacatacatacgcatatgtgtgcatataaatgtatgtatatgttaagtgtatgtgtatatataagttatcactatacatatatatttgttatcactatacatatacatatataagttatcactatatatatatatatatatatatatatatatatatatatatatatatatatctttgctatcttagcaatctcttcctcacaggccaaggtgttcctcatactttgataactgcagcctctcgaatgatccttgggaaggaaaatttgagaacagatacattggcttctctcttatactcagccccaaagtctctgtcctgcttccttagcatctcagagccttgctgtgtgcctggtgacaacagctggtaatagtaatcaagccaaagaatcgatgcattatttgtctcaaaacacaaagagcctaggcctgcggagagggtacccaaaagtggtgttaatggcaggaggttcgagtatcatgctgagtacagtgcagaggctatttgagttgaagtggggtgggggaaagaaaggtgtagattttcaggccaccccctacatgccacctactcaattactgaattgaactgccctgctgaattactgccatcctcaagatgacttagcatttatacttcaatgttcacctacacaagggacccaagaaaaggggataaacagaggaacagaaagggcttttctttttaaattaaactttttattttgaggtaggttcacatgcagttagttcacatgtaaattgtaagttatcacaagttgtaagagagatcccacataccctttacccagtttcccccaatggtaacatatcattaatataaaacttagtataatattaaaaccagaatattaacatcaatacagtcaagatgcagaacgttccatcactacagggatccctcatgttgcccttttatagccacacctatttccctcattccttttctttaacccctggaagtcacttatcttcatttctatacttccttcattttcatttgacatgttatataatggaatcatgtaatatgtaaagttttgggattggctttttttaacttaacataattctctggagattaatccacatcattctatgtatcaatacttcattcttattttgtcattgagtgtccatggtatggatgtatcacagtgtgcttaaccattcaccaatgaggcacagctgagttctttacagccagtctccatccagatgggagatatatttccttgaaaattcatgaaaagaatgtcaaacctcccggtatccaaggtgaaagcagagcccaagagcacacatagcagctatgtgcccacagactgctgaggctcaaaacctgacagttcacccaaagctctgggccctgcttctgcccagcagggcactgaggctaatgggtgctttcataaaggggtatgggagggaggcaggcgtcttattcagaaacttgaatctggacttcaaagcaactaaagaaatgaaatggcaaccgaatcccaggggagtgggggagcagaacttctgccaaatctgaaatctcttgcatttttttttctgaccttttgggcaagatgggggaggaggagtcactcctaaatgacttcctacagggcctatagggagatatatggtttctctcagcagtggttacctctggaatgagaattcagggtgggcaggatctttcctttttaaattaatgtagttatgaaccagatcgttttttcccacaatgagtatatattctacttttgtcatcatagaaacaactaattttaaaaagtcatggtagggtgtggcatgggggaatgaaaacaactgattggctgcaaaggtgttctgaatggagggtcccagttgaaaaatgtcttgggcattccttcactcctgcttttatttatttatttatttattttactttttacttttttgtgattaaaataaaactttttaatgagatattttgcatttgcattttctcacaagtctttaaaatggttattttacatgtaattttttatttttaagtcttgggggtacttagtaggtgtatatattcatagggtacatgacatattttgatacaggcaggcaataccatcacatcatggagaatggggtatccattccctcaagcatttatcctttggttactaaatccaattatattcttgttattttaaaatgtcaattaaattattattgactatagttgccctgttgtgctatcaaatactaggtcttattcattctttctatttttttggtacccattaaccacccccacctctcccccagctcctcactactcttcctaacatctggtaaccatccttctactctctatgtccctgactttgttttgatttttagatcccacaaataagtgggaacatgtgatttatttgtctatctgtttatctatctatctatctatctatctatctatctatctagttatttatttattttagaaacaagatcttgctctgtttcccaggctacagtgtagtggtgcaaacttaactcactgcagcctcaacctcctgggttgaagcaatcctcccacctcagcctccagagtagccaggcctacaggtgcacgccaccacatccagctaattttcttttttgaaatgttttgtagagacaaggtcttgtgatggtgcccaggctggtctcgagctcctggcctcaagcaatcttctcgcctaagcttcccaaattgctagtgctacaatttggaccaccgtgtgtagccccaccccatttaattttgggggcacccactctttaatgccctcctccaacccccagcttagtctcagtagactgaacatagcttcaggacctcagacaccgtgccccctgtcccctccaaacacaatgttttatctggactctgctcccacatgcaggaaactgctttctgatgcatgatgatgaaaagcatatatgggtcaatcagaatcagtcagattatgaaaaccctgttggagccaatgtgaaaaatctccagaaacacagtaccatcaacccgtggggaaagacataaggacctcaggaaattctttcatttttttctaatgctgataatgaatatttcagccacagcagtaggtttctcagttaggacagtttgactggacaatggccaggaccatctatgacagtaagattctgacccacaacctctacatccaccagccaggaaaccaaaccacagtctctcagcaatcactccagagcagtcaggacatggtcaatctcacatcccagatttactatctttgccactgtcccttccacttccaactcaggaataaccagagaaagtgaaataggtcccgcacaccaatcatgtaggatgccttgtttctagttaaactggtccagttttcccttgccaacagcctccaatcagggcatatgtttagccttcccttttttcactataaagctttgccaccccctgcctgcctttgagtctctgccaacccaaattgtggtggctgacccctttgctatagcaagctccggataaataccctcttttgttcttgtttgggtgatctttgtttattctacaatgtcctaccacatagctgggttcttgctccagcctgctacctgccactggccagggctgcccacaatgtccacactggcacacttgaactgttccaaccacattgaaatcgagcactttcatgattaagtactgtccccacagttgctaccgccttttggcaacttggtagcttggtgtagtgataaaaaatattaatattgaagccagaaactccagcatttattagctgcatgacttcaggcatgttacttaccctcattaccacatctgtcaggtggagggaataatgtcctctggatctcttttgtagaactgttgctgcatcttggagggaggcagccttgacctagagaggtatctaaatgtttgggtcccggtccctcaaagcagtggttttagccaagcgctcactgctaagcagtgggataagaagggaaaacttaacaatcctcaaagccttcatgtgggaagtatggatcaggctttggcccaagtcactgagaggttatcatacctggcttttcctgctcttctggcccacggccagggaaaagaatgcctgtccttctgatgggcttgcaaaaagatttattgaggaatgaatgaaaaggtccaagagtctttgttttcttcttatttagccacacatcggggcttttggaaagccacttaatcttcctgagtctcagtttccccatctgtaaaatagtaaaataacctccacccttcctgaatgactagatcattatgaagatgtgatggaataatgtatgtgaaggtatgtttaatttttttaagtgttatacagttgcaagtaacgattcttaggggacatatatttacaatggaagtcttggcaaagagaggccaaatgaggaaggcgaaggttcttcacgttttggagctgggctccaagttcaaccccaagggccctgccccttgcaaaggactctccctgactcctcgtgatcctagagtgccccagaagtggcttttccatgtcaatgagccctcattcttttcagagaatgctcagaaatgaaaaccctctcttgcgtctctcatacacagcacttaacagtctacaggccttcctcctatcctggctcctcacagaagccaggttttaaagctgggttgtttggtgacatctctgttctagaacatgctgcctgtatggccttaggcaaattacgtactctctgtaacccagtttccccatttgtaaaataaacatgaaaatgaagtagtacctacttcacggtattgttgggaagattaagtgagctgatatgtgtaaacacttaacagtgcctggcacttagtaggtgcttgataaaggttagttactgttattttcgggcagggcagggtatgctatccccattttagtcaactgtagaactaggatcaaaactgggacccttattctaagaaaagtcattttttttttgtcactctatcgcccaggctggagtgcagtggtgcaatcacagctcactgcagccttgacctcctagactcaagcaatccctccacctcagcctcccaagtagctgggatcacagacacatgccaccatgtcaggctaattttttgtagagacggggtttcaccatgttgtccaggctggtcttgaactcttaggctcaggcgatccacccacctcgacttcccaaagtgctgggattagaggcttgagtcactgtgcccagccttaagaaaagtcattctataaaactgagagcactcaaggaatacaagaaaatattaatatttgcaaaccatacatcagataagggattcatattagaatatatgaagaaaacatcaacaacaaaacaactcagttaaaaaacaggcaaaaaacctgaatagtcatttccccaaagaatagacaaatgaaaagataacaatcactaatcatcagggaaatgcaaatgaaaaccacaatgagatattactcagacccattaagatggatactttttttttttttttgagacagagtctccctctttcgcccaggccagactgcagtggtgttatctcggctcactgcaagctccgcctcccaggttcacgccattctcctgcctcagcctcccgaatagctgggactacaggcgtccgccac[175 bp omitted]aagtattggtgaggatgtggaaaaattggaactcttgtacactgttagtgggaatgcaaaatggtgcaactactatcaagagcaatacagtggttcctcacaaaattaaatagagaattacttcacaatccagaattctaattctggccatatactctaaagaattgaggccaggtgcggcggctcacgcctgtggtcccagcactttgggaggccgaggcaggcagatcacgaggtcaggagattaagaccatcctggctaacatggtgaaaccccatctctactaaaaattaaaaaaaaaatagctgggcgtggtggtgggcacctgtagtcccagctactcgggaggctgacgcaggagaatggagtgaacccaggaggcggaacttgcagtgagccgagatcgtgccagtgcactccagcctgggcgacagagagactctgtctcaaaaaaaaaaaaagaaaacaaaaacaaaaacaaaagaaaacaaaacaaaaaaaaatagaatggaaagcagggacttgaagagatatttgtgcacccatgttcacagcattattcacaatagcaactgaaatgttcatcaatggataaatggataaacaaatgtggtatatacacatgatagaatattattcagtcttgggaaggaaattctgacacgtactacaaaatcaatgaacgttgaaagcatgctaagtgaaataagccagtcacaaaaagacaaatattgtatgaatccacttgtttgaggtacctagagtgctcaaattcatagacacagcaagtagaatggtggttgctaggggttgtaggggtcagggggaatgtggagttaccatttaatgttacagtttcagttttgtgagatgaaatgagttccatagatggatggcaatgatggtagctcaataatgtgaatgtagttaatgccactaaattgtacacttttaaatggttcagatggtaaacactatatgtattttaccacaggcttaaatttgtttaaattttaaaattagtacagtggctggagaggatatagagacatggtataaaagaaagatcagaattgggaaaatgctactagaggaatagtgccagaccttttcccagcatgccacagttcccattatctagttaggctctttccagcctaatgatttctgctcaatttcagaaggacttttccctttggaatccaagaaagtaggaaatgaggtttacttatatgttaatacactacatatgttcaaagaaggaaaacaactcttttctttcctaagtagcaattgctcctcaaacagtatgacattttcaaaaggaacttgatcaagaacatcaccactcctattcaacatagtgttggaagttctggccagggtaattaggcaggagaaggaaataaagggtattcaattaggaaaagaggaagccaaattgtccctgtttgcagatgacatgattgtatatctagaaaaccccactgtctcagcccaaaatctccttaagctgataagcaacttcagcaaagtctcaggatacaaaatcaatgtacaaaaatcgcaagcattcttatacaccaatagcagacaaacagagagccaaatcatgagtgaactcccattcacaattgctttaaagagaataaaatacctaggaatccaacttacaagggacgtggaggaccttctcaaggagaactacaaaccactactcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaaaaacaaagctggaggcatcatgctacctgtcttcaaactatactacaaggctacagtaaccaaaagagcatggtactggtaccaaaacagagatatagatcaatggaacagaacagagccctcagacataacgccgcatatctacaactatctgatctttgacaaaccagagaaaaacaagcaatggggaaaggattccctatttaataaatggtgctgggaaaactggctagccatatgtagaaagctgaaactggatcccttccttataccttatacaaaaattcattcaagatggattaaagacttaaatgttagacctaaaaccataaaaaccctagaagaaaacctaggcattaccattcaggacataggcttgggcaaggacttcatgtctaaaataccaaaagcaatggcaacaaaagccaaaattgacaaatgggatctaattaaactaaagagcttctacacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaacaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaaccagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactactcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaaggacaaaaaaccaaacaccgcatgttctcactcataggtgggaattgaacaatgagaacacatggacacaggaaggggaacatcacactctggggactgttgtggggtggggggaggtggggagagatagcattaggagatatacctaatgctaaatgacgagttaatgggtgcagcacaccagcatggcacatgtatacacgtgtaactaacctgcacaatgtgcacatgtaccctaaaacttaaagtataataataataaaataaaaaaagaaaaaaaaagaatacatataggataattacaattttctaaaacatcctctctgtggaaaaaagattggaagaaaaaatgtcaaaaatgttatgtgattgtccttaggctgctgaaagatgggtttcaaatattttaatttttcattctattttaaaattttcctataatgaaatgtattacttttggaatggaaaaaatgctttaaaaccgcccccccccaaaaaaaagacaaaaaacagatttctccatgtacctgatacaaaatgatcagtagtcatttgaaaaacatgactgaacacttactccgttacaatgttctggcgcattttacatgggaaataaagtattgtgttttgattaaaaaaaaaaaaaaaagcttcccatagcttttaaggttaagaccaaacttctcagcggactccttaaaggtctgtcatgatctggccttggaagcctgctgactttgccagcctcagctatcaccctgcttttccttgatcctctgttctaccacattggtcttcttgcaggccctccatgcagcctttgcacatacagttccctctgccagaaatacccttccttccactctttgcctagttaaagtctactcatccctcaggtctcagcaaaatcttcactgcctcgaggaaaccctccctgatctcctgaaaagtcagaacatccctattatgtgttctcatagcatttacctctcctttctagaatttttcacaattgtattttaacattcatttcttgataatgtacttaatgtcttactcgccaactagtctatacgttccatgggggccaggaccatgtgtggtttcgttcatcagtagggccagcacagtgcctggccatagtagagtgcttaataaatatttgttgaatgaattaaagaattaatggcaaacaaaaggaaataatttttaagatgaaactgatagacagtcaagtttccaaagtacagagatatctgatcttaaaaatccctaataaaagtattggggtgtttctctgtgtcttgaagctcctcaaagccccttctcttgaaatgattatattctgattaaatgggacaggttcataggaactgtatctatttccctccctccatatcccaacttacctgccagttttatagctcttgagtgcaccagctccatgcatcagaggcacattctgctgatgcccatccagccctgttcgccactcccttaacccagtaggcataatgcatgatccagaatcagtgtagctacagcaagaggatggcagttcctctgagctccccactaagggctaacaaggctagaggccagggatggatggcgaagtcctgggtacctggaatgcaaaaagctcagggtgacgggcaaagcctcagggctggggaggagggaaagaagcacccagttacccactctggagtcgagtcaaagaatacatacctgctgctatccacctatcccctaagccctgtctaactggagtcaggaaggaactgtcaacagattccagatgggagtcaggaagatatttttcctccagaacttggcacttctgttcatctgcagagattaatacagactagcagaaaggattgcctcctgatttatgaggactctatgacaaggtagtctgggagccaggagaggtgggattccaacccccacgtccttatgtctggagagccacatttttgtgggaggaaatgcaaagtcaattaatttttgacaccatgtaaaaaactggtatttcctgacccaacaccagggcagctagaagtttataaatgaagactctatggttcctttgtttgaaaatatgtaagttgttgttggaataaagcagctttagttctttattggaaatattctgtgttgggtaaatagaagccagaagcatgttccactgacggtatgacttcagcatgggcaggctaatgaaatgtacactgtcagcctgggctgcagaggcacatggcaagagcaagctgcacattgttgccagagtcaaaggaagcccacagagtaggtggaatcaaaacaaaacttcccaaactttgctgacgtgtgccttggacaaggtggctttgtgactgtgcctggcctgattcttctctgtgcttgacctctcagtcagcacctctaggactttgctcatgctggtcttcagcctctcctgccccactaactgggatgtcagggaccctaacctgggcaggtccccacttttcttttgctatgtttcttcatctaggaaatgagaagtttggaccagaatctagtaaccagatgttctctctggtgcctccaattcctcaccccatctgtctctcttccttctaggtgggtaaacagctaacatctcctccaggaagccttgccaccttataaattctatctggccctacactgcataatcacactcaagtcatttcatgggtgcacaagccagataggtctttggatacgggaaccatgctttctagttcttttgtctcacaccccatcttcaacatgtagtggagttttctttgtaaaactagtatgcaatccaggctgctgactgactagctgagtaatcaggtggttacttaccaaagataaaagaaaattagaagaatttttgaaagaaaagcaataaaaatgagagttaaatggcatcaagtatggttgagaacagggattctagagtcagtcagctgcaggcttaaaacccagctttactgagtactaactctgggttcttgagcaagtcactcacattccacgtgccttagttttctcatctataaaaacagggataataatagtcctaccttagggctgttaccaagtttcagtgagatcttgcatgaaaagtctgcagcatagtgcctgacatataagaaatgctccaagaaatgttaactcttttatgttcatgatggtgatgtgaacccatcccaggagggccgatctcaaggcagaatgtccacaggattggcccactgtttcttcctccctactcctaaaaaagtagatgtgatttccagaatcttgaataaatgctcggttgcctttggaatatccacacttgacttcaaggagtcaggaagtggtgatccgaggtcctcttttacttgtcctcacaatttaaggaaatgtctttaggaaacatggaaattcaagggtacatatgtggcctgttacaaatggcggacataggagaattagggaggggaaaatatagatttggggatatcagcaaactctattcttagaagtgtaataaaagcgcaaaaggacacataaggagggaattcacacagaatccagaaatccctcctcagaaacacctcaaagctgggcctctctcttgttatcaagctgctattggacatctccacctggatgtcccatgggcatttcaaactcaacttgtccaaagttgagctccttctctcctctttattcataatctcctaagcctctctttaccacccaatttgccaaattaagaaatagaaggtcatcctcagcactgccttctgtctcagcacatgactgtcaactaatccacaagctgtgtggatctgaattcctaaatagctctctaatgcacttatggcttgtcttccgccccaatttatcaactctccttggactggaacaatattcttctcaatatctcctttgctattactcagttaatttcatccccctgccatgtacaaaaccaccagagggaacactgtaaaagtcaaatctgcccaggtcaatttattgctttcaaaacacctccctgtcttcccagagcctttgcagtgaagtgaaaatacttggagagacacaagccctggccacagctaaattgtctccaacactctttcttctcatgggggcctcagatagtttacatcaacaagaggagggacagattataggtctatgagctgccctaattcattattggcatgccatgctattttactcttgtatgccacctctatccaaaaagtgctccccttcccctcctttgacctggtgaatcttactcagttttcaaattttactcaaacctcacctcctctttgtatgtcctcccttcactacagcctctcctttgcatgctaatgttccatataagaccttgaacacgctcctcgtactgtaattgtctgctcaaactgaggcccttcctgggcagggaccatattttattgatctctatctttagcactcaacacaagactgagaccaaagaaggcatttgaaaaggtttgtggaatgaactcatggcctcactaagtccctattccctataacaacaggtcagtgtctaatgagagctcccagactttggcagggatggaatctgagaaatttcaagggacttgagttctggccttggctggtactcaatgtgaatgactttttgttccgggcccaactgttccatctccactcccctgagaagaagcacaaagagaaacagggcagtggcactatcatagtcttgatcctctagtcacataattcctctgcccttttcaaatcctccctccatccctcaaggtctagtttggaccttttccatgaagaaaaaacattctcacccgagcccaggaagggattccttctcctctgaattcctgtaaagttcattgcctgggcaagtctgagacattgaggctcagaaagagaagtgacttgccatagaccccaagtctcctggggaatgtgatcaaaacagattcctgtgccagaccctagacctatgaaatcagaataaggatctgggggacatcttttgaaaagtactaaactatctcatgccagatctatgttgtgtctcctcaactggcttaccaggggctgatggcagaggctctttcttcttagttctctgtgtcctccatggcctcatatttgtgtcctccacagttatctgtgtcctccatagccccaaactacaaaggttttttcattgactaacccctgggctgcttccccatgagaaaattaaaatgaataaagaaacccaacttaaagttagtctcagggcaccaaggaaaagctggccttggcagtggcagccttcctcggatgctgctttctgtctgattttctaagtgccaaggttatccttaaccaaaattattccacattggaagattatgtttcttaggatgataaagggtcatttacttggaccccctcagacatttttctcaactctgttttgggaagaaaaatgaacattccaaaacaaaacaaacaaatgaacgcaccaatgcatgaatacctggacatacactgagatcacagtcattttttttttttttgagacaaggtctcgctgtaaccgtagggtgcaggggcgcaatcgcggctcactgcagcctcaaactccccagagctcaagcgattctcatgcctcagcctcctgagtagctggaactacaggcatgtgccaacatgcctggctaatttttgtatttttttgtagagactggattttgccatgtttcccagtcgtgtctctaacttctaagctcacgtgatcctcccaccttggcctctcaaagtgctggaattacaggcatgagccacggcgcccggcttgaggccacagttttatactttgttgatttctatccctagcctgggcaatgattccagataatcaagaagatgaaccacctcacgaaggttcgttacagtcactaggctgagctcattaaggcaggaaggtagcctcagatattgtggtaactcttctgacaaggagggtgacaaaataggctttctgtttgagcctcagtttctcagaaattcctactaagccccttccccaggattctgatcagttaaggttctacttggctgagaaggccagagttatctagacctcaggcctaggtccccactgactccactgaccctacctctgggaagaaaagtggcctacatccttgtcacccatcagaaaatagacacaggatcagccccagcctgaccccaaagattctttctcatactaaaaagccattgccctgtccctgggcctttgggcacagttggataggcaggaaccctggttagaagaagaaagggagctcactcattcacttttgtcactagtcatcccatgcacagagacgtggccagcaagtcctctctagagtccattaacactcgtgtgcatccagagcttctctggtcacccctctgggagtagaggggtgaccaggcaagctcccctgagaaggatgcctaggagttgaatatactcaggcaagacaattacctcaagtctccaaaaacgtacaagatgtttcctgggacgccagagggttagtgtgaggaaggttatgttcggttgttaatttccaagggcaagtgcagagtgagaaacaagagataagacctgaaatgtcaggcaccaggtagacactacagtggaggcaggattgaaaaacaagggtgtgggcaaagtgagaaagcccaattacattagggatggcagaagtgggagtaggggtaggaaattgaggcataactataggtctcaaggacatgaacagattattctgagttaaagctccaggtcctggatggatactaaggttttctagtggggcctcaacaagaccttgccctcagggagtctgaagtgtagcagggcctttctgtacttaaagaagaaactgcagtacctcccagccttgggtcgccaaaggccaccaaattgttgaagctagaaaaagtcattggcatgatagtaggccctcctctgtgtaggaaggtgtcactagtcaaaacttctgcattggttttgagttgtttttgctacatgtgagatggactggccctgacttgccacattctctcatggagtttgcagtgtagctaaagaaatatatttgccaaatcaggctcacttcattatcaagggtttcctgactgatgcactatgttcctaaaaactgatataacttgaccgccaatccctgaaggcacctaaggaaagaaacattccagtttcaccctggcctatgtagcttgataagcactaagctctacagttttctgggctttattcttgttagctgaaatcagtggaggcccaagggcccatgaatcatatgaactttctgactttctgataccttttgaatctctacaattccatgaaaaggacaataaacccttataatcctgggggaaggaaggggagccattccatcgtctttcactctgggatatttttaacaagaataagaactactgagctaggcttggtggctcacacctgtaatccaagctactcaggaagctgagggaggaggatcgcttgagccaaggagttaaaggctgcagtgagctatgattgcatcactgtactccagctctggacagcagagcaagaccccatctctagaaataaatacataaataaagaatttccatccaatggagcgttattcttcatgcaaggcagtatgtagaagtgctttacctacattacctgaactaattcttacaacagccctagggcagaggtgctagaagtaggtccacttcacagaaaggtttaatgacttgcctaaggtcacacagctaatctgaggcagaacccagatttaaactcaggtctattgaatcttaaagcccatgctcttaatcactgcacctgtgtttctcaaagcaggatttcggtaaacatgagcagattcccaggccccaccccagatctgttgactcagaatcctgaaaggtggggcctgggaatccacatgtttaacaccgcaccaggggctcttctacattcagaagttttagggccctggtgacactatatggcctcctgcgtttgccatacagtacaggcaagaatgggtaaagcttccatgccaggcctgacatttctcagcacttttcccagcaaatctgccacctgggaatggtcactgaaaatcttttagcaggaccaggacatccgagccccttcatctagaacagggactcttagcccttatgggatcatatacttctttgggaatttgttgaaagctctgggtctctcctctttcccacacaggcacatacacacagaggcccacactactttggtggcctccactgaaaatatacacacataaccctttgcatatattttcagggagtatatatatcttctgaggccccttcatgagccactctgcagctcaaggaccccacatcacagaggcctctgacctagaaatgtgaacacagactaggtccagtgggcatgttgtttttaaatcctttctatgttagagatgcatactggagtattacagatgatgtgatctgttgtctgagatttgtttgcaaatacacccagctatgaggggatgacaggcatggggagcagcaagatagctccagcaagaatgcccataagttgctctttgttgaagctgggagatgggtacatgggaattcattccactggtctctctactgtttgtgtgtgcttagcaatgtccataatcaaaagttatataaaaaaattagggtgagtgacttggtatgtgaaatgtgaattatatctctgtcaaaagacaaaattgcaacaaatacagtttaaagatatgaattggctttaattgtgattctagaatctagcagcacctcattctataaaatagaataagtgttcacatgaactgagcaggggagtttggttttatagacagaaaagggccgaggagagcagaaacagagaacaaaaagcaaattccaaagttactttccttgtaaaggttaaagcagaggggacttatcatgctggctaaaactggcttgtggtatttggctattctctctcactcttttgatttctcagaagatcagataaacaacttagtttcagcttggtgaaatgcaaccttggcatgagtgactgttttggtttggtctgttgggtctagcgcaggagctcagtccaaatcaatgggctcctataaattttatttaatatcttcataagactgcttttaaaaacaattaacctccttatctgatccacctaaatctgccagtggacacatgtactaaaggccaagagagaactatttaatttcctgcttgctgttctttaaagtcataacagttaatcaaaacctcttgatcttgctaagatggcagaaccacaccaagcaggcctcattagggaattgagaagaccagttgctgtatatgaaggactacatgtacaaggactactctgctaatagcacaataatgataatcatcatttacattccaaggtcagagcactttatgaagagacatgaaactgagagttaccaataccctctccagaagcaaaaaaaaaaaaaaaaaaaatagcagagatcccattaacaggcctaattccctgctgtttaaagcttggaataaaaaagatgtttcctgagtggatttcaaagttcttaaagctagcaatttgtgaggtttcttagcaaggtctcataataatcaaacaggttttctatgcaggaggatatgggggtggagggtgaagagtgacatccctacctgtgtgcaaacatttgcaaagaggctccctcctctcccttcttgtcctgaaatgctgaagggaccttccccccataagctccccatacaaaaaaaaaaaaaaactgtggttcttgcttgggaggtaaataaacctatagccatctgcagagttgacttaaccacatctccatttttttatagcatatgttcctctaccactgcaacttctttataaaatggggatgacaatggtccctgcctcagagggttgatgtgaggtttaaatgagattttccgggtgaatacctcagaatgaggcctgggcacaccacaaactctcaataaatgttagttattcttattcatgttgttgttttctttggctcactgcagtacaagccaagccattccttagatatagcagagtgatagccaatagcatccatctggccccttcctctctagtggacttacataggaccaggctgctaaaactatccagggggcagtaggtagggaggaggaagtagaagggaggtggagataagaagacagtggagtctccgctgggcttagaaagacctagaagtctgctctgtccggtcgcacacactggtgtaggttgcccatcctctttcttttctttaatctgcgttagtgatatctccatgccttcttttttccctttatgactgtccttgatgtgcatttccccaaatttcatctggatgtgtgctaggccagaaggaaatgaccacagagtgtgatacctgcctctaatcttcactcagggctggccatcaatttgccactcccactagtgtgatgatgttacccctaattgagtgcactgaatcagtgcttcaccattcaaatggtaattgttccctctctcagattctccaaatggaagtcctactttagcaccatgttagcagcaaatggagaagtggtagccatccttcccaaaacctactccttctctattcccttgtttcaattagttttgtttacaataactttggttatttctttaaacaatttttctatgcagaaggccatgaaggcattttaaccagcccaaccctctaaaggatgctctctgaagtccagccagtctacaacactgtgaggggagccctgtaatctgctcttcagaatataccctgatccttattttgaaattctgtaagtggtacttaataaggatgccagctgagtagcaccaaacaaataagaccaaaagaaacctccacaactcctggtaaataagcaacacagaacatctgattttacctaaatcgaatcttgagtgtctcttggatgaaatttttaaaataaaaaataaaagtgaatccttatttagtggatataacaaaaaccataagaagagagtaaccagcatgctcagaacaagtccaactacccccacaaaacagactccactgccattggtcacagtcacattcctctgggaccctggagactacatatgcaaagagccacaggttttgggggcctggtgagcaagggtcaacagatgacaaattgtgtggggcccagagcccaaagagccagttaatatctctccaacaatggcccttctggaggacactggccccatttttctcttggtcccattgttctgcccaggacccagggtttcaagggcaggctccagctgcctttgatgacaagactaggttgtgagaaaccacagatgggaaatggtggcatatgcactctgggtcacacttacagaggccattagagcagggacattcagcacccagccatctggccactgcaggaggagagcaggaccctgccttttgaacaactctccaaggagcccctctgtcaccaacttatcactgtgcagtcctgtgatcctccggatctctctttttttttttttttatactttaagttttagggtacatgtgcacaacgtgcaggtttgttacatatgtatacatgtgccatgttggtgtgctgcacccattaactcgtcatttaacattaggtatatctcctaatgctatccctccccctttccccctccccccaccccacaacaggccccagtgtgtgatgttccccttcctgtgtccatgtgttctcattgttcaattcccaccacttttttttttttttttttgagacggagtctcgctctgtcgcccagcacaacaggccccggtgtgtgatgtttcccttcctgtgtccatgtgttct[137 bp omitted]tgcctcagcctcccgagtagctgggactacaggcacccgccac[138 bp omitted]cccggcctgaatctctttttatatcactgcctctccatccccagcctggtgccagatgccaaggcaatagccacgcttgtggggccaaaccaggaacccatgtgttaacaaagcagctggttcttccatgcaatctggatccagctgtaaatatggcagtcatgaggaagggcacagagctggtgaagaaatgcagcaagtccacttttccttaggcatgtggaaatcatatgctttgctgagtgctgtgacacttttttttcttttgagacagggtatcactctgtcacccagactggagtgcagatctcagctcaccacaacctccacctcccaggctcaagcgattctcctgcctcagcctaacgagtagcctgggattacaggcttgtgccactatcgcccggccaattttttgtatttttagtagagatggggtttcaccatgttagccaggctggtcttaaactcctgacctcaaataatccacccccctcagcctcccaaaatgctgggattacaggagtgagccaccgcacctagcctgctgtgatgaatttttaaaacaattttagattgggttcactctgattgccaaatctctactgctaactgctgtgcacacagggagatcacaccggtttttgttatgaatgtaagtcaggaatggattgaaaagtcatagatgtgctgtaataaactctcagactggaatacaaaaatattttaattcccttggagccagacctgaacctcaatgaactagaaacttcttgaccagtgacttcaaataaccagcaactttctcctggcttgcctcaaccccttataggaaaatgagctatctctttttatatcacaagagagtggaaaaaaaattgaagtggagaatattttgagcacatcacattcagcccagtctctatttctctatctgtggcacttggtcatttgttgtcaaatttgagtgggcaccagaatcatctggagtgcttgcttaacaaaaagagtctcaagctcaccttcagtcattcaactggaacatcaactaatatccagaaaatacctgctatatgccaggcaccatggtaggtaccagggatccaacactgaagaagaaagagtccctgtccacaagaagcttacaatttagtgaaaaaaacaggcaagaaagaaagaaggtaatagcaggcatctatgagtgctatgaagtagacaaaacatggaggtgataaggagagactagggtggggttatggttttagatagggtgaccaggacagacttctttgaggaggtgacattctgctgaggcctgaatggatagaaggagccagccatggaaaaggcattatatcagaaggacgagcaagtgcagagatcttgctgtgataaaaatgtgtttggtccattcaagtgcagaaggacagacagggccaggtgcagtgactcacacctgtaatcttagcactttgggaggccgaggcggaaggatcacttgatcccaagagtttgacaccagcctgggcaacaaagtgagaactcatctccaaaaaatatgagcaaaattaaccgggcatggcggagcatgcttctagtcccttctacttggtagactgaggtgggaggatcgcttgagcccagggagggttccagcctggacaacagagtgacagagggagaccctctctaaaaaagtaaataaaaaaataaaaataaaaaacacagaaagaaagccgacagaggtccaagaagctgaatattgaacaattgccctcctcctccaggtgattctgagatagaggcccagttgaaaatccctagaatagacagtcattcagaaccctgaccctgaggcttgaaacatcatcccaatcagcaaaactgtgctgtgctatttaacgaaaaggaaaagatttcccagaattgtgactggtacacagtagtatctgatgaatgaatggcagccagcaccaaaaatctcctgatgctcgatgagctcattttcaaagaaacagaatttttctcaaacaaagcttcaaaagaagtgagataaaaaaactttctcaaaagccaaaattgacaaatgggatgtaactaaactaaagagttactgcacagcaaaagaaactaccatcggagtgaacaggcaacctacaaaacgggagaaaatttttacaatctacccatctgacaaagggccaatatccagaatctacaaagaacttaaacaaatttacaagaaaaaatcaaacaaccccatcaaaaagtgggcaaaggatatgaagagacacttctcaaaagaagacatttatgcagccaacagacacatgaaaaaatgctcatcatcactggccatcagataaatacaaatcaaaaccacaatgagataccatctcacaccagttagaatggtgatcattaaaaagtcaggaaacaacaggtactggaaaggatgtggagaaataggaacagttttgcactgttggtgggactgtaaactagttcaaccattgtggaagacagtgtggcgattcctcaaggatctagagctagaaacaccatttgacccagccatcccattactgggtatatacccaaaggattataaatcatgctgctataaagacacatgcacacgtatgtttattgcagcactattcacaatagcaaagacttggaaccaacccaaatgtccaacaattatagactggattaagaaaatgtggcacacatacacaagaaatactatgcagccataaaaaaggatgagttcatgtcctttgtagggacgtggatgaagctggaaaccatcattctgagcaaactatcgcaaggacagaaaaccaaacaccgcatgttctcactcataggtgggaattgaacaatgagaacacttggacacaggatggggaacatcacccactggggtctgttgtggggtggggggaggggggagggatagcattaggagatatgcctaatgtaaatgacgagttaatgggtgcagcacaccaacacggcacgtgtatacatatgtaaccaacctgcacgttgtgcacatgtaccctagaacttaaagtataataaaaaataaaaaaataaaaatctgtttcttcttgcccactagttacccaagaaagcattgtgagaatctcccactttctgagcagccatgtccagggtagtcactgcattctgaggtaggagctcagcctcactgtggagccctgtgggcttacaagaataagaactgattgaatcagctgagctcactactgggatcaaccagctgtggccacagccaactgggttccttggaaggcccacatcagaatttgttgatgccaggtgccacctacaggctgctgggagcctggcctattcactcaggaatcccggccagggttgctatggggcctgcccaagcctcctggaacctctgcatgatcccattgagtaatgagggtctgggtcatgttttggggcctctcccctgtcccttcatgcatctctcccaacacctcttacctcaggcagccagaaccacgtggggcaactttaacctggaccagtggtggtacctggtgccacacctagacaggtttataaaatctacactccagatctcttcctctccctcctgcttcctttgccaaacgaagccttcctgtggaggcttctacttctgggaagatggaataaatgtactacttttccccattcttcccactaagtacaaataagaatgctagactgtatatacattacgtacattatatactttttaaaagagaaagaaaaagaagaagattcaaaggtggagacaggggccagacatgtggggtcacacctgtaatcctagcattttgggaggccaaggcaggagaaccccttgagcccacgagttccagaccagcctgagaaacaaagggagactctgtctccatacacagataaaataaaataaaataatgaaataaaataaaataaaacagagacagaaagcccagagaggtccaagaagctgcattttcaacaagtgccctcctcctccaggtgattctgagatacaggccaggttgaaaatccctagaatagacagtcattcagaaccctgatcctgaggcttgaaacatcaccccaatcagcaaacctgtgctaagtgctatttgctgaaaagggaaagatttcccagaattatgactggtacacagtaatatctgatgaatgaatggcagccagcaccaaaaatctcctgatgcagaatcccatcaagcttattcaaaatgtatatgaagagccagcggaacttatgaatagacaaaacaatttcgataaagaacaaactgggaggaatcattctatctgatttcaggacttgctacatagctacagtaatcaatacaatgtggtattagcaggggggtggacacattgattaatgaataaaatagagaagccagaactagacccacacaaatatgcccaatcgattgttgacaaaggtgcaaaagaaatttaatgtagaaaagatggccttttcaacaaatggcattggaacaaatgggcatcaataggccaaaaaagataaaataacgcaaaatggatgatggatttaaatataacatgtaaaactagaaggcttttagaaaaaaaacaggaggaaattttcaggatccaggtgtaggcaaaagttctcagatgtgacaccaaaagcacaatccatgaaaggaaaaattgataagttggactttatcaaaataaaacctttttctctgtgaaagaccctgttaagaggatgaaaagactaggagaaaatatccaataaaggactagtatctagaatatataaagaattctcaaacttaacagtagaaaaacaatccaattagaaaatgaccaaatgacacgaacatatacacatatacagatggcaaactagtatatgaaaatgagttcaatattgctagacattagggaaataaaaaataaaaccacaatgagatacctatcagaaaggttaaaatgaaaaaaaaatagtgacaacacaaatgctggtgaggatttggagaaactggatcattcatacattgctggtgggggtgacaaatgatacagccactctggaaaacatcttggccatttgtgctttctagggggaggggagagtttaagggaatttttattatacaagtagttcctcacagtgatttgaaaaagtatgagaccatatgaagaaagtttagtaatttcagatttactttgtaaaagcatgctgacaaatattaaatgttatacttgcaacatttatatatatataaacatctatatatctgtagagatatatacatatctctacatacatagagatacatagagatgtttatatatatataaacatctatatatctgtagagatagggtctc[132 bp omitted]aatatgaaattgaaacacaaaacatccaatgttaaacactgatctcccctgcctgacttggatttagatattgagtattttgtattttatagaaaggaactttcaaagttttgttaatgtatgtacttatagtatatatcattattcctcaccaaaattgtcatgaaatttaaaagactggtattaaaagttttttttttttttgaatattttaaaaccagtttggattaaccttcagattttcagggcatgatcgatatgcaaatagagaacccaagaatgggttttaggacatttagggtaagtttgtttacagttgtgacaaaaataccttcaacttttagatatgaaaaaaaaataccctaagcaaacataaaagtagttgggtcaagttactttttaatacaaataatacattgtgtcaatcaatttttaaatcaaattctcaaaagcatttagaaaacatttgtattttataattgtcaaacaatgcatttatgtagtggaagaagatacaagtaaagcttataaaatcaaaaactctcaaacttttccaatttccaggataagaaatttgcaaattaagaaattactgatttgttggaaaatatgccttagttttactctcaactgcttgacatacaattaactgcttgacataccattaactgctttacatacattaactgcttgacatacaatttaatacttaaaaagactgtatctaagctatttaataatattcatagagtattacttctctggacagacgtgtttcatacaacagttttcaactgttaagaggaattcacttgataattttaatcataatttaagattgattaaggaattaatttattcagtaatttagatgcaataaacaccaataaaaggaataatccagtaattgctcattgtgcaattctgcccattaatactgagctgagaatttgatagatatttcactcagttgaattacgtgtttctatgtgagatattgatcaacaaaaaaaataggtacacaatgttaagctttttcctttttctttttttgttttaacagcaggtcaatgatttagggagttggttagtacaatctacgaacatagcagaaaagtacaaaatgtcacataacaccaatgccagtacttgtcccattatggttttaaataagggtattattcatttttatgttgttttcttctttaaaacgtaaaacaaaaccattaacttgaatttgaggtatacacacaatacatacacaattgtacgcaaaatactttttttctttttttttctttttttaattattatactttaagttctggggtacatgtgcagaacgtgcagttttgttacataggtatacatgtgccatggtggtttgctgcacccatcaacccgtcacctacattaggtatttctcctaacgctgtccctcccctagccccccaacccccaagaggccctggtgtgtgatgttcccctccctgtgtccatgtgttctcaatgttcaactcccacttatgagtgagaacatgtggtgtttggttttctgttcctgtgttactctgctgagaatgatggtttccagcttcatccacgtccctacaaaggacatgaactcatcatttttatggctgcatagcattccatggtgtgtatgtgccacgttttctttatccaatctatcactgatggacatttcggttggttccaagtctttgctattgtgaatagtgccacaataaacatacgtgtgcatatgtctttacagtagcatgatttataatcctttgggtatatacccagtaatgggatggcttgatcagatggtatttctagttctagatccttgaggaatcgccacactgtcttccacaatggttgaactaatttacagtcccaccaacagtgtaaaactgttcctatttctccacatcctctccagcatctgttgttccctgactttttaatgataaccattctaactggcgtgagatggtatctcattgtagttttgatttgcatttctctaatgaccagtgataatgagcaaaatacttttcataagtagcattacattttaaaatattggaaatgctatctgtactgatttgcattttgacttaatagaacaagaagagaacaacattcaactaaagaaggctatactgataataaagctcttaaaattcaaaatgtcttcctctccctttgtatttaccacaggctacacaatgtcctgagaggattcattatgagaaaaatgtcaatcacagctttaataacttacttttgagggaactaatgagaaagcaaattggaaggtgagacttatctgctttcaagtaagtagtcttaatttttcttcttatagaaaaagcttaaataggtttattattaaatatatttaaactattaatttttgcagctttcataaaggtcagcacttcgtatataccaagtctatgagaagacgtcagcaaaaatcatttgatcttaaacggtgacatcatccgttcaaatcctacctttaatagaagttagcttcaaaaaactgggagatttccgctacagtcatgcattctttaacatcttgttaattagcaaaaatcagcaatccagtttttcttaagtcctcatgtgctaacattttacagtgttcttctctagttacagaaatcctgtctgtaccgtccacacaactattacaaactccgtgttagtatagtaaacattccagaaagaaagaagagactcttgaccaccaatattccacagtaagaaacgtgtattattaatcactgtctcctttacattacttcctgttgtacgggagttatgtacaacttcactcacagaaaatttgaaaagaatgatagttttccctgcgttatccagtcccacgataataactttgtgctcctggtgactgaacagtctccatgtttggtgaattcccactctcgggcagcaaacccccctccaatccccctggactgcctgaccgcccctgtctcaagctgagtgggaggagagagccgcaccagagtctccgcctctgctgctggggctcctgctctcctggctcaaggatatagccatcttgttgtcagccatgagcctcgagggccaccatcctccccaaagtgctctgggcagctccacgtaggccatttctttaaaaagttcaacattcttcctaaatcatacaactactatatgatccagcaattacacttcttggacatctctcccagaaaaatgaaaacttatgttcacatacaagcctgcacactaatgttcatagcagctttattcataatagctcagaatgagacaagagaaaaaggtctggaggcaggcaacctaaggccgtttcaccctgaattcctataacaaaattgaaaggaaagccctaactttccatacctaagtaaaaaaggaccagaggctactccttttgcaaacccccaccggcagatgggaaattgaaagtacctctgattgtttgctttttgcggccaagtctttgtttgcatagaagtgcaactttgtaacttctctttagcctctgattggttgctttccacaaccaatgagatgtttgcataagagtgtgaccttcgtaacttcacttcagcctctgattggttggggaaagctttctgcaaccaatcagactgattgtgggccaccacttcatttacatgaggtaaacaccaagtggccaatgagaaacctctagagggtatttggccctgagaagattctatatctggggcccttga[134 bp omitted]gcaacctctgcctcccaggttcaagcgattctcctgcctcagcctcccaagtagcagcgattacaggcacctgccaccatgcccagccaattttcgtgttttttgttttgttttttgttttttatttttagtagagattgggttttaccatgttggccaggctggtctcgaactcctgacctcaggtgatccacccgcctccgcctcccaaagtgctgggtgggattataggcgtgagccacggtgtccggccctgtggagtgtactttcattttcaataaatctctgctttcattgcttcattctttccttgttttgctgtgtgttttgtccaattttttgttcaaaatgccaaaaacctggacaacttgcagtcgagaccctctaccggtaacaaaaactgaaatcagcccagatggtctcaaacaggtgaatggttaagcaaactgacacatccataccatagactacccactactcagcaatttaaaaataaaatgaaatgtatggatacatgcaacaacctggatgaatttccatggagttatgttgtgtggaaaaggccaatcccaaaaggttacatactgtatggttctatttttgtaacattcttgaaatgacaaaattatagaaattgatatacacctactatatacccacaaaaattaaaaattaaaaagatatacagaaatggagaacagtagttggcagacgttaaggaggggattggtgtgggaggaaagtaggtgtagttataaaagggcagcatgagagatccttgtagtgatgggatgttctgcatcttgattgtattaacatcaatatcctacttatcatagtgtactatagttttgcatgattttatcattggggaaaactgagtaaagaatacgtggaacctttccgtattatttctgacaactgcatgtgaatctatctcaaaataaaagtttaatttaaaaagaaatggcctttctgtttatcctcttctcttggactctgctatgataattcttgctgaggtgtcagtgggtagtaaaggcactgatattatcccacctctcacttacatctcaacaggggctttctggaaattgtagaaggccaacattttgtagaaaaaactacctttaaattaaaatcaagataccttgaggcctggtcttaacatgctttgcgacactgggcaaactgcttagcctctctgagattctatttcatctgtaaataaaataaaataaaaaatctttgagggttaagtgaaaacacttggtaaatcttggtaaattataaaacactacacaaaaggaaggtcttcttccctctcttcctcctttcctgtcctcattaattcagctcaaggaagcgatcgtgtcctaggtcttcttgtatccctacggcttagcttaagtctgtgctctaggaggtgtttcataaatgatggttaatgctgataatggcagaatgcttaaagcaagggtttggctctaacagattaaaggtggttcagctcctagtggtgagaatttgaagagcccttcatagcatcccaagtagacagtgccctgccctgggcaaaactttactcacagacatcaagggaaggaaagtcagagcccatggaactggccagctgccattttggggaaccagagaggtaatggctagaagcaaaaagcttctcactttgaccaagaactttcctacccattatcttctttgctcctcaccatcctcctgaggcaggcatagcatagatcaaccccattctacaatttgcaaacactgaagctaaacaggactgtgacttgctcaaggttgacacagcgaatgaatcagtaacacagctggggacagactcgtgggccagatattttccacagcacagatggttaccaaatggaaaagctaagacaaagaaaatgcaggccttccccaccccaactcagagcttctccccagagaattgtggctaggcttcccagccctctccacacaatctcccatctaaagaagctgctgttgctgcaggcctggcagtgttgggatgctgcctgagacggcttccctccttccaagctctgagcttacagtgacctatttaaaggcagagaaatcagtctggggttagggcctctcccgagcaggcagtgcctctcacagatggctctccagagccttcccaggcacttcttccaacttctcctcggtgatgacagctgggggtggggtgggcagggaagctcacttctcatctgtccctgaaagcccagaatgtcctaagaggcttcccagggtctaaagagaaccaagttagggcctccctggaaggcaggctaaggaaaggtaacagctcccctccctgtgccctggccagggtctggatgcttttcccaggggccctatctctccactgctgcctccaccgaagctccaggatgaaactgaaagggaaatgtgaaaatgcaaatgctccttgggaggggaagtgtcagaagccatttgcttggattagttcatccatttgtaggttgccaacttggaaagcagagaggaccgctgaggccaggacgagacgaatggcagaggagcagggtttgaggttgcagtgagggctcctgagcatccagcctttcagtcagcaagccattcagcaatcccttactgagtgcctgccctgtgtctggccctgtgctgtgtcccaggggccactgtttctgccctcctattgccctcagtctagaatgaagggacagaactcccagaggagacatgaggcaagaagtatgaagacaagagcatatgctcaggccagtctgttttggcttccagtcatcttgtgggaccttcagcaactggcctaaccattcatttgttcgtgcattcattcacattaaccattccttctctgaataagtactcatggagtgcttactatgtgctgggcactggagatacagcggtgcccttctggagcttacagcctaatgggggaaaagacaaaggaagggagtggggaggaggtggcgctcctttagatagggtgttaaaagagacctctcattaccatgaagtcacactttaagagttaccccttaaagatccacagatgctttccagcgagcgctgccaaacctgaaatcgaacagcatcctgaagaaactgccaacattttgcagacatacaagactcaaaaatgggtccctagcacctcgtaaaaaccttcccccttacaaggcctctcaccagcatacagggaggtttgagtagggaaggagaaagggcgttggaatgacgctcttgaacatccagctgttcggtcagtgtgtcatttagtactggcttactccctataggtccaaaaatttcctccctgtcttaaaggcacagtaacttaggaccagtcagctttactttccttcattcatgtgttcaagaagaatctactaaacatccacaaagagctgacacttctctggagtctggagattcaggggtgaactagatagccatggcctctctgggagtttacagtctagtccataggagagacagagattaattaattgcatgaataattaataacaattgtgctaagtgctttaaaagagactataatagggagaacctcattcaatggaggagtcagcgaaggtgtacctgaggaggtgacttctgcagctgaggcctgagggataagcgggattaggccaggtgaggaggtaggagaggaggaagtgttgtcttacagacatgtggaggaatgtggaatcccagaagccagatagtgtggtactttgaaagaacacacaggttgaggctgagtgaggtaggaagagaggctcaagatgagttctgggaaataggcaaggagggaccagacaggcagagcctcacatgccttgataaggatttgggtttcatcataagaaatttggggagccactgaagggctttgggcaagaggccaaatcaagtttgcactgaggggagggggggcagccatagtcaaagtgcagagacagctggaaggctgccacagtcatccaggtgggagatgatgacaggagctttgattcgtgtggcctggtaaaaatggagagcaatggacagagtccagacatatttaggaaacggaatcaacaggacattgtgatggattgcctatggagcttcagtgaagggaggcttcattcccattctctagagtggggctgaggacacataggagaaaatcttcaaaaccaagggcttggtaaagacttggatggatgtcacgggca[142 bp omitted]ctactaaaaatacaaaaagttagctgggtgtggtgacatgcacagtagtcccagctactcgggaggctgaggcaggagaatcgcttgaacctgggaggtggaggttgtagtgagctgagatcatgccactgcactccagcctgggcgactgggcaacagagtgagactccgtaaaaaaagaaaaaaaaaaaagctgacctccaaaggttgcatatgatatgattccatttatataacattcttgaagtgataaaattgtagagatggagaacagattagtggttatcagataagtggtattcctaccaggtgaagggaattaagtgaatgtgatcacgccactgcactccagcctgggtaaaagagtgagactctgtctcaaagaaaaaaaaaaaaaaagaggaaaataaaagaaagcattcaataaaatgaagctactattaaaaccaggtactgccccctgttttcaggaagcctccaattcagccctgtggacagggaaataagggaacctgtgcctagggtgacattcatgagtccgggagactcatattgtattaaatagaggaggtgggaaaagaacggagagggtaagggaaaacatgaggacattttaaagaaaaaactaggagtacttaggcaaattagaagttgaggttacagaaggaataccttaaaagtctttgaaagacaagcctgcatttattaatgtgttcacaggttattaactctttaactgaaagtctgaggagtaaatgtcagggaaacttcagcattgggagcccccttaatggcatgtcagtggaaataactgtgtcctactagggacatgttacttctttaataattctctcctgaccaaaactcatcttttaaaaaaataggctatttttagatatatagaatagttttaggtatatagtaatatataggaataatacatataactatagaatagtttccccatagattttctgtcctttagcttaaggccagactccctttacaatcctaatcttacctaagagtagattttcatagggggagactacgacatctctcaggtgacagaagaagggaacagggaatatgggtaagaagagggagaagtcttctctttcctgtgtaagtctgccaggcctgtgtggacaacttatcatgtcagggtgtatccttcacccttcttattcattgctgagagctcagttcagtaggacagagcaagcaggcccatgatgatgatgaggaggaggaagagaaagatgacatgagctaccatgtttcaggtacctaccatgtgccagaaactatgcatgcattttctctaattttcacaacaaatcttacaaagaaggtagtactgttagcaccttttaaaagatgtaaaaacagcttcagataggtcaaaaagtttggcagagccgggttaagaacccaggtctagtcttgtcccagatgtccactttgaaggagaccataatagggaggacttcatctgatggaagagtcaggaaaggccttaccgaagaagtgtccaaaggcctcttctccagacaccctctccttccttaagagtcagccagcacttgctcacacatggctgttaggctcccatttccctggtgacaggcagtaagatgaagatcagataaagagccagaggatgatcagaaccccaatttggtcacgtgtttggattcaaatcttctgttccatcaagttgggcaccccccaccccacccaaaaaccgaggaggcctaaaatctgcacagtgtaatttcagagtgcctacccctcctctcatttgctgtacctgaacttgcagccttcctttagcctagccctcttttctcccatgtggggtagggacccactaggtcctctaagctgtcaacatgcaaacctctccaggagaggccatggtggcctcatagtgaattccaagtgaatcccaagtaggatggaagcttctgatggatgtggagataaagagagattaatgagttagaagggagaaagaccatcatagaatgaggggagaactgaagaatgatgttggggaaggagtgaaattgaatatactaactttgtgaatgtttcagaagagaaaaccagtgtctcctaaggtagccaaacaggcttaaagtcttgatgcgaagaaaaccaataaatgaaacctggcactgaaaaaatgacaagaaagaagaacattaagttaattgtagttgactctgggttatgggaatatggatatatgtacatgtatatacatatatatgtgtgtgtgtgtgtacacacattactacaatatagtacagtaatatgtacataaagaaagagatgcgttccctggcatccaggagctgccctggtaccatcagctaggtcttggtgttggtggtagctgtccttgcacttacagctggaccatggtgatctcctattgagcatgaacaatctcacagaacggcaacatcagacaaggccactctgtgacaacgatcaacgaaggcaaaaaccagaccacaccataattatgtcttaacaaagactaaacatgaacattgcccaagccacataaagaatcaaatgtccccctctcctggctaataagagtgattgctgcttcttcgttgcttctttgccaattgcagctttagcctcactagcttgccctctctctggatactctctaaataagaatacctagtcacagaattggccccgcttcctgatagcatccaatctagagccaacaccagcttccttaaatcctccaaaaatcacaggacacaagcccaagtcctataagtgctttctaacactctcttcttgagatggccatggtttcccatagtgtgtattattccttgctgctggagagtatggagtatgtgtgcttgatagacagatagatagattagatagatagagagatagatagataggtgaatagatagatgtatttcacacatgcatatttttttttctacatgatttggtctcagctttaaactcttcatttggcatgaaaatggagccttggtttgacttctgaaaaacagaatgaagtcattagcaaagacaagggatcaacccaggttcccaccaatggtggattggataaagaaaatgtggtacatgtacactatggaatactgtgcggccataaaaataatgaaatcctgtcctttgcagcaacatggatggagctgaagaccgttatcctaagcaaaccaacacagaaatagaaaaccaaataccacatattctcacttacaagtgggagctaagcattgggtacacatggatataaagatgggaacaacggacactggggaataaaaggagcggggaagggaggtgggtaagggttgaaaaactacatattgggtactatgctcactatctgggtggcaggttcaattgtactccaaacctcagcatcttacaatatacctttgtaacaaacctgcgcatgtaccccttgaatctaaaataaaagttgaaaaaaaaaaaacagagtgaagtctcattaattgaaagagccgtaactcacaatacttgatgagtactataacaggcagctgaggtttacctttgccccaactataaaaaatgaacagcaagctatgaaaattaatcatctgaataaaagtgactgtgagacagttcagctagtttaaaagtagaatcaatttgcatgctaattatgtgctaattacgttattcattaacaaaggtcaagggaacctctacttagttacatcctgttaggtgttagttgaggttactgttttacttgaaaacaaaaagtctataaatcagacttcttattaaatcagaccccttatttcagggggcctttatctactaaattattttgaaacagcaaggccagctacccatcacataccatcaggggtccccggttgattcatggagcaaagtcacattgagtgaatacagttattccggccatttcagcaaagtaatttgccatcttgtctcagtctatttgtgctgctataacaaaatacttgagacctggtaatttataaagaacagaaatgtattttctcacagttctggaggctggtaagtccaagatcatgacaccagcgtggtgtctggtaagggcatcttcccatggtgtcctcacaatgtggaaaaggcaaacgccgtgtcctcacatggcagaagggtaaaaggggcaaaaggcagctagggctctcccttaaagctttctttttttatttttaaagatggggtctcaccttatcacccaggctggagtgtggcgtgatcatagctcactgcatcctgggctcaagcaatcctcataactcagccctcccaagtagctggaactataggcatgagacaccatgtacggctaatttgttttattttattttttgtagaaatggtgtctcactatgttgcccaggctggtcttgaatttctggcctcaagtgatcctcctgcctcatactcccaaagcactagaattagaggtgtgagccaccacacccacctagacccttcaacatcttttataacgtccctaatcccattcacctcccaaagaccccacctcataatattatcacattggggattaagtttcaatgcataaattttgggggacacattcagaccattgcacacatctcttcaccattcagggcatttcgggggcgcattcttcactcctccctagtccatggtttctcaactttggcattattattttggtgcagataattctttgttgtggaggatggcttttctgccaattacagcttcagcctcactagcttgccctctctctagataagatttattgaaatacctagtcatagaattgaccctgcttcctgatagcatccaatctacagcaaagcctagtttccctaaaccctcccaaaatcacagaacacaagatgtatattttactgtactatattatattcatatatacacacacatttacatatacgtttgtatatatatacatccatattcccataaccctgagtcaattacagttaacttaatgttcttcttttttcatctttttttcagtgccgggttttcatttatctaaaggtctgtccccacaacattaatattcattacaggatacttagcagcatccctagccctctacccattagatactagtagcacaaccctctcctagtcacaataattaaaatagcccccagattttgccaaatgcccctcgggtgcaaaataacccagttgagaatcactgttagaatcccccagttttactgagtggcttgcacttctaatctcttttgaccaccccccaaccagcaatcccccatatggtttgtctgtatccccacccaaatctcaccttgaatcaattgtaattatgctcacatgtcaagggcggggccaggtggagataattgaatcatgggagtggtttcccccatactgttctcatggtagtgaataagtctcacaagatctgatggttttataaatgggagttcccttgcacaagctctctcttgcctaccactatgtaagacgtgactttgctcatcattggccttccaacattattgtgaggcctccccagccatgtggaactgtgagtccattaaaatctttttcctttataaattacccagtctcaggtatgtctttattagcagcatgagaacggactaatacaacccaccccccaccctcacacacacacacacacacacacacacacacacacacttacttaaaatagataacagagagtcatctggagtcttgaccctaggcttattgctgcctccacacagatgcaagggcagcatacaaccaaggcacagttggagagatgaggcttagataaccccccagtcagcctcctggaataaaggaggatttccaggtgtctgtctgtcactggcccctttgcctttgaggggactccagtggttccccttgtttaaccacctttcccctctacaattataggagggaccccttgcctcccaactgtttaagtgctcagtgctagaaacctactctgtgttggccctgggttaaaaagataggtaaggcaaacaagtgacagacaatcccaatacagtttggccagggatctgagagagagaaaagccccaggagactgtgggatccccaagaagggggcctggcctagcctggaaagtcagggaaggggacctggaggaggtggcatttaagccaagttaggaaagaagaatgagaatgagcaaggcaaagactgcactgggctgagctggtctgggatagggccagagaggggtttagaacagatggatgtgtgtggagggcagtggtaactccaagttgttgggtactgccctagcttgaacaggagcaatgagagatggagcagagtgataggcaggggcttgctcaaaaaaagccttgtatgccaaggtcagaatgacattctttatactgaagagttgtaggtcttgaagaactcctagaaatgttactggataaactccgcttggtcatagtgcattattctttttataagttgctgaatcccatctgataatatattgttgaggatttctgagtctatattcgttagagatattggtctgtaatttgattaattgactgactgatggactgcttgattgattggtttttggactagctttgtctgtttttggtattagggtgatgctggcctcataaggtaagttctattttctgaaataaattatgtagaactgctgttattttctatttaaatatttgttaaaatttaccaatgaagccatctgggcctgggcttttctttgtggaatgtcttaaataactaatccaatttctttaataattatagagttattcaggctatttaattcattttgggtagttttagtagtttgtggttttcaaggaattgatccattccatttcatctttgttttttttttttattgtttgtttgtttgtttgttttttgagacagtctgtctctgttgcccaggctggagtgcagcagcgcgatcttggctcactgcaaactccacttcctgggttcaaccaatcctcgtgcctcagcctcttgagtagctgggattgcagacatgcaccaccacacccggctagtttttgtattttttgtagagacagggtttcaccatgttggccaagctggtctcgaactcctggcctcaagtgatctacctgcctcagcctcccaaagtgttgggattacaggcgagagccaccacgccaggccccattttgtcttaattgtcaaatttatgtgtacagttgttggaagtacttccttattattcctctaaggtcttcagtgcctgtgttggcatcccctgtttcattcctggtactgatcatttgtgtctttctttttttctttgtcagtgttgctagagatttgttattttcattgatcttttcaaagaatctgtttttggtttcattgttttttctgttgtttttctattttcaatttcattgatgtctgctccttattatttccttcttttggtttgctttgggtttattttactctgtaggtttttcaggtagaagcttagattattgatttgagatctttcttcttatataagcctttaatgccattgtaggggcagaaagggggtgattccttttctccccatttataaaaggtcatagccaacaccccataacaaaaaacaagttaacaagagaaaaacataacaaatttattatgtgcacatgtgtgcatggaagtcatacaaaacatgaactcaaagagggaccagatggttgaggcttaaatgctctcttcataggggaatgggaaatggatgaacaaataggcccaatgctcagacaatggtttgtaaatgattctccttggaaagatgagaggcagaactgcacaggaaccaaagttgtcttattatgcaaataaagtctctcagataatctctgggagccgttcttagaatccatgaaggtttgtctgggcatggtgatgactcccagtctcttctcttctccagtggttgatctttcctggttatttcatgagatccctagggtggaggtcttaagacaattgcatttcttttggaaaaaaatctttcttaggcagataaggaaattccagagagagagagagagagagtccttccctgtgcttgggggaaaaggatcagaaaaacaaggaagtgggggatggcgagcgggggttgttcagagagagaccttggctatgaggcttatttctgaggcctttcaattttcaaagcagtcagcatgccaaagagctatgttttgggggatttttttctgcaccccaacactacaaatttccatctcagctttgcattaaccacaacccacaaaattgatatgttgtattttcatcttcattcaaaatatcttctaattttccttgaatctttctctttgacccatgggttacttagaattatgtggtttactttccaagtatttggagattttctttttatctctctgttattgatttctagcttgattccattgcagtcaaagaacatattctgtaatttcaattctttttaaaaaatttatttaaatttttttattttttattttatttttatgttgttgttgttgttgttgaaatggagtcttgctctgttgcccaggctggagtgcattggcgcaatctcggctcactgcaacctctgcctcctgggttcaagtgattctcctgcctcagcctcccaagtagctgggattacaggcatgtgccaccatgcccagctaatttttgtatttttggtagagaaggaatttcaccatgttggccaggctggtctcgaactccggacctcaggtgatctgcccgccttggcctcccaaagtgctgggattacaggtgtgagccactgcgcccggcctaaaaaattttttaaagatgggatttcgctatgttgcccagggtggactcgaattcctgggctcaagcgatcctcctgcctcagcctcccaagtagctgggacaagtagctgggactataggcatgtgtcatcacacctggttcttaactcttacatttgctgagacttattttatcactgctatggtttggatgtttgtcccttccaaaattcatgttgaaatttaattgccattgtaacaatattaaaaggtaaaacttttaagaggtaatgagatcccaaggcctctcccctcatgatggaattaatgcccttatgaaagggcaggtttggcctcctcttgcctccttcctctttgttcttctgctatgtaagtaatagcattcctcccctccagaggatgcagcattcaaggcaccattgcgggatcaggtccttgccagacaccaaacctgccagtgccttgatcttggacttcctagtatccagaactctgagaaataaacttctgtttattacccagtctcagatattctgttataacagcacagaacagcctacaacgatgactcaggctatgacttatcttggtgaatgtcccatgtgcacttgaaaagaatgtatattttgctgtagtgagtagagtgtcgtttcaatgtcaattagatcttacttggttgatgatgttgagttcatctataacacttgctgactttgtcttagtcatgtacatttttaccagatttagggaaataaagtgcagccctcacttgatacccgctgctctggggattgaatgggggatggtgaaatctgatttaaggggtgccagtacaaaaggtctccctgacttcaagtttctcttacacacaggtgcaaaatttgatgatgttcaccaacctaaagcttcttctccagcaggaggcccctgagattagatacatttctctgattaagtcttttccatccacacagcaggatatttagataggttggcctgcaagagagttttgttgttgttgttgttgttgtttgtttttgagacaatgtctcgctctgtcgcccaggctggaacacagtggcgcaatctcggatccctgcaacctccgcctcccaggttcaagcgattctcctgcctcagtctcccgagtagctgggattacaggtgcacgccatcatgcccggctaatttttgtatttttgtagagacggggtttca[142 bp omitted]aagcactacattggagtttctattacatttgtctctatcacagctttgccttgagccagtccctggctctgtgagcctgtaggagcctggcatgaaggacctcagaatgctggcagctcccatagcacacatgaaagtaaaggaaaccttgatgttccttgactgatgtggtccaggggctttcccagggttggtcctgcccagccccatgcccatgctcatatgagcacagttcctgtgggttgggcagaccagaagataatccatctgaaagatggcatcttcctttctttcttctctggggcagtgccagtaagagccaccattccctactcacatgtatttgctccagcaccaaggagcacactgccctctcctcccaccagcgcctacacatgggccttgtacacccccaaacatgcacctccagtcacagttttccctctgagcagtggggtgggagtgaaggcataagaaattgggtagggggttgtgtggagaaccccatattctcttagctatattttcccactcttcctctctcttccttcctcccaaattatggctggaacacaggtagggacttccaagggggctgtgtgggtggggttaggtgcagaagaaaaagtagtcaaagagagtagttcttaatgatcaatggatcccagagcctttgggaaatttgataaaatagttttgggctttcttcctagaaaaacaatgcccttgggatggacccacagttattcctgcagttttaggagtgtttgtaacctcctgaggagcagtccttggggcccactttaagaaactctggattacaggaagtggcaacctatctgtccctcttccccttcagatgggagaaagcctcctttctctctaactcacaaagcatcccctctatcctcttgaatgaccaagattacttcttatttttatattcaaagacaatagccagatagtaaagctgtagcactagctattaacctagaacttaatcaccaaagaatgattctcttagtttcacatttgatctcattgatttgtgcttccagtccctagccatttgggctgtttgtgggggttgatttttctggatatcattatgtctacagagagagtgtgatactagggtatcttgggtgactgcagatttatgcaaagtgagatatagggagtaaagggtgaaaagggtgccacacgcttgaacttggttgcagcaccaagggaactttaaaaacttacatgaatattgggcttggaaggtttggtggggtgtctgaatccctgttaatttttatttaccccaaaaagtaaataaaaattatttatatagtacagcccaagatcaaaacgcatcttgcatcattttatgatgttacttactttgtacttttaaactgctcaatctcagactctctcaaccaacaaaattattttgattattttattaggcaaaaaaaaattgacttggccatcctcctctatctcatctgtcagtctggtaagcgttttttctgggagatcccaaggactgtggctaagtcaacttgatttgcacttattttttcccactgccatgtccaaatcattcagcactgtcgtcctagacatgaggctgccgctcaggcccagactcccaaatagttgtatgcaagtaaccccagctgctgaggctgggaggtacttctgaaggtaacagaagaatccatcttcctgcagatttattgaatacggtgtcagcttccttcccatctatttccaacatatgcagacttctgtgctctggtgactctaaaggataaacaaagactgtggtcaagttgaggggagcagttaaatattgtgatgccctgaaatgcttgaaacatatttcctgcatcttagggtactgacctcagatcctagagctagataaaatgcaatgggatctgttttatagagtggtacagtaaataaaaccatttcaggacaaaagtgaaaaccataccatcctatatctcattcagctatgcaattttccttttaaaattttttatttttattttttactttttaaattattagggtatttctacatttcaaaactcaaaaagtacaaaagacattcagggaaaaacctccttcctatgtctgttcccacccaagttcccttaccagaggcaagcactattattagttccttctatatccttccattgatagtctatgtatttttctgttttattacctcctctcaaagtttggattgggatttttgggcagcatttctagtttgtttctgctagaagtgtttgtgcttcacttgtaataataggtcacaggacaggtcacagcctgctctgcaagacttagcatctcatgtactgcattttaagcatttttattccatcccacaagaactaatgctttgcatccttctctaatctctgtgagggaccccaagacgagtaaagcctttatcactgccctaaggatcttctttgttagttggggagacaagactacccatctgaaacaaatgacaggagcagatggagtgcattgctgattcatgggactggttttttgaaaactttaaatgccaggaggaagtttggctttgatactgttggtcttttaacctggtggttaaatgtttttggagtcagagtaaatcttggctccaatgccagctctggtgcttaatcaattctcttaagctctctgagccccagtttcttcctctgtgatatataagagtatcatttactaccatggattggaggagatgatgaagatgcagcacctggcatgaaatgggtgctcaataagtgggttgattgtgctttttgccggagaaactacatgaaatttggggccattaggacaccatgcatgcatgtgcatttgtgtccatttgtgtgtgggtgaggggaggaggggtattgacaattaagtctatgagctctaaggcacatgagcaagacagaggcagggagaaggaacagatggaaactctgctgatgcatggtagctgatgctgaatccatggggctgagcttcccagttgattgctaaggcaggaatgggatggggtatctttaacagcttctgagcatgatcatgacatgccaaaagtaatgtctgaaaggattcatctgggagtggtgtggaggctgatatgctaagaagcagaaatagaggcagggagtccagtaaggactgtcatcaaggtgatagattctcaaaactgatgctttgttgggtatgaaggaaatggatgagttaaaggtgaccatagagtttccagccagaggaaatggatctatgacactgcctttaagagaaagaacaagagaggggagctcagtttggaggggaaagaaagggcagtatgtgtcctggggacagcaaggcaactaaatgaaacacaacactccactggagcaggtagcttgagactgatccctgcaaatagaaggaatgcaactggaaaggtttcatatcttagggggatcctaagattggccagctccccaatttccttatccctctagcattctcaacagaagaaatctgccttaaaggagagagggagaagcagaatgtgactatgttgacttgagattagggactgtctagattgccatggtgaccaggacaagaaacgtgatgcttttaccatcaagcatatcttccagctgtattccgttatacttcctgctaacgaaggttctgagcagctctgtttgccccgtagtctgaattgagcaaggaatagacctggggctgcaccctgacaggctgtggagatagattcgaaggcctcagctactccgcactgcactaaccctgaggtctgtcccatgattgcatcatctcagatctgcctggtcactgaagcctagactgggtgacaaagtgataacctttgtgataccaacttttcaagtgctcattattctgggtacattcctaactcccctgtcctggtggcctcttctcttgtgcttgttgcctagaagatgatgtaggcaaaactgctcagaggacaacatagagagctcattactggagcatgacattcagataaaaaagactacatattttccagaataggcaaattcatagagatggaaagcagattagtggttgcccgggtccaggagaggaagaaatgaagagtgacagctaataggtacaggcttttcttttggggtgatgaaaacattctgaaattggatagtgatggtggtggttggccaacactgtgaatatacaaaaaataaataaattatgcactttaaaggagtgaattttatatgtgaattatagctcaataaagctgttatataaaaaaaaaatcaggtagatttctgcatctgtgtctcatacaaagcccttaaatatgtatacacactggaggtagctgcattttcactgtcaaattgctcttaagagttgatattactatattgatatttagcaatagcttttaagttttctaaatcctcttttgctcaaactaagaaagcctgagatggggtaaaggaatgtggatggagggctattttctctaatgaggaggctatagggtgaaaaaaagaaggtttcaaccaaatctaccaaaacaaaaccaaaagcccaacaaactccatgaaagtggttggtacacacatttcagagaacctagggtttttcgttggccttggcagtaattctgaggagcattgacataaggacgaactgtgttccccttattttcctgagattctaggcataagcatgtctttccttaacatctggcagacatttaattcacctccccattttgaatgagctattgtgtccagaattggtgggttcttggtctcactgacttcaagaatgaagccgcggaccctagcggtgagtgttacagctcttaaggtggtgcgtctggagtctgtcccttctgatgttcagatgtgttcggagtttcttcctattggtgggttcctggtctcgctggctcaggagtgaagctgcagaccttcgcagtgagtgttacagctcttaaggtagcgcgtctggagttcttcattcctcctggtgggctcatggtcttgctgggctcaggagtgaagctgcagatcttcgcagcgagtgttacagctcataaaagcagcatggacccaaagactgagcagtagcaagatttattgcaaacagcgaaagaacaaagcttccacagtgtggaaggggactggagggggttgccactgctagctcaggcagcctgcttttattctcttatctggccccacccacatcctgctgattggtagagccgagtggcctgttttgtcacggcgctgattggtgcatttacaattcctgagctagatacaaaggttctccacatccccatcagattagttagatacagagtttccacacacaggttctccacggacccaccagagcagctagatacagagtgtcaattggtgcattcacaaaccttgagctaaacacagggtgctgattggtgtgtttacaaaccttgagctagatacagagtgccgactggtgtatttacaatccctgagctagacataaaggttctccacgtccccaacagagcagctagctacagagtgtcgattggtgcactcacaaaccttgagctaaacacagggtgctgattggtgtatttacaatccctgagctagacataaaggttctccaaggccccaccagagcagctagatacagagtgtccattggtgcactcacaaaccttgagctaggcacagggtgctgattggtgtgtttacaatccctgagctagatatactctccacatccccaccagactcaggagcccagctggcttcacctagtggatcccgcaccagggctgcaagtggagctgcctgccagtcctgcgcggtgcgctcgcattcctcagcccttgggtggtcgatgggactgggcgctgcggagcagggggtggtgctcattggggaggatcgggcggcacaggaactcaaggagtgggtgggaggctcaggcatggcgggctgcaggtcccgagccctgcctcgcgggaaggcagctaaggctcagtgagaaatcgagggcagcgccagtgggctggcactgctgggggacccagtacaccctccacagccactggcccgggtcctaagtccctcattgcccggggccggcagggccggccagctgctccgagcgcggggcctgcccagcccacgcccacggggaactccagctggcccgcaagtgctgcgtgcagccccacgtcctgctggcacctctccctccacacctccttgcaagctgagggagccggctccagccttggccagcccagaaacggaatcccacagtgcagtggcgggttaagggatcctcaagtgccgccaaagtgggatcccaggcagaggaggcgcggagagtgaacgaaggctgtgaggactgccagcacgctgtcacctcagtggcgcacacctgtggtcacagctacttgggaggttgaggtgggaagatcattttgtgaccagaattggtgggtttttggtctcactgacttcaagaatgaagctacggaccctcgcggggagtgttacacctcttaaggtggcacatctggagtctgtcccttctgatgttcagatgtgttcagagtttcttccttctggtgggttcgcggtctcgctggctcaggagggaagctgcagaccttcaccgtgagtgttacagctcttaaggtggcgcgtctggagtctgtcccttctgatgttcacatgtgttcggagtttcttccttctggtgggttcttggtctcactggctcagcagtgaagctgcagaccttcatggtgagtgttacagctcttaaggtagtacgtctggagttgttcattcctcctggtgggctcggggtcttgctggactcaggagtgaagccgcagatcttcacggtgagtgttacagctcataaaagcagcatggatacaaagagtgaggagtagcaagatttattgcaaagagcaaaaaaacaaagcttccacagtgttgaaggggatcggagcaggttgccactgctggctcgggcagcctgcttttattctcttatctggccccacccacatcctgctgattggtagagccgagtggcctgttttgtcagggtgctgattggtgcgtttacaatccctgagctagatacaaaggttctccacgtccccatcagattagttagatacagagtttccacacacaggttctccacagccccaccagagcagctagatacagagtgtcaattggtgcattcacaaaccttgagctaaacacagggtgctgattggtgtgtttacaaaccttgagctagatacagagtgcccattggtgtatttacaatccctgagctagacataaaggttctccacatccccaccagagcagctagctacagagtgtcgattggtgcactcacaaaccttgagctaaacacagggtgctgattggtgtgtttacaaaccttgagctagatacagagtgccgattggtgtatttacaatccctgagttagacataaaggttctccacgtccccaccagagcagctagctacagagtgtcgattggtgcactcacaaaccttgagctaaacacagggtgctgattggtgtatttacaatccctgagctagacataaaggttctccaaggccccaccagagcagctagatagagtgtcgattggtgcattcacaaactttgagctaggcacagggtgctgattggtgtgtttacaaaccttgagctagatacagagtgccgattggtgtatttacaatccctgagctagacataaaggttctccacgtccccaccagagcagctagctacagagtgtcgattggtgcactcacaaaccttgagctaggcacagggtgctgattggtgtgtttacaatccctgagctagacataaaggttctccaaggccccaccagagcagctagatacagagtgtccattggtgcactcacaaaccttgagctaggcacagggtgctgattggtgtgtttacaatccctgagctagacataaaggttctccaaggccccaccagagcagctagatacagagtgtccattggtgcactcacaaaccttgacctagacacagggtgctgattggtgtgtttacaatctctgagctagatataaagactctccacgtccccaccagactcaggagcccagctggcttcacctagtggaacccgcaccagggctgcaggtggagctgcctgccagtcccacgccatgcgcttgcattcctcagcccttgggtgatcgatgggactgggcgccatggagcagggggtggtgctctttggggaggctcgggccgcacaggagcccatggagtgggtgggaggctgaggcatggcgggctgcaggtccagagccctgccccacgggaaggcagctaaggctcggtgagaaatcgagcgcagcgccagtgggctggcactgctgggggacccagtacaccctccgcagccactggcccgggtgctaagtctctcattgcccgcggccagcagggctggccggctgctccgagtgcagggcccgccaaacccacgcccacggggaactccagctggcccgcaagcgccgcaggcagctccggttcctgctcgcgcctctccctccacaccttcctgcaagctgagggagtgggctccagccttggccagcccagaaaggggctcccacagtgcagcagcaggccgaagggctcctcaagtgccgccaaagtgggagcccaggcagaggaggtgccgagagcgagcgagggctgtgaggactgccagcacgctgtcacttctcactatcaagggtgttctcaatatgcaatccagcacacatcttcatgtacactgtggtgaatacgtcccctcagagctaaatgaaattcagttcaacaattgtttatctagtgcctaccatgcacaaggcaccatagaagaacaaaacagctcttcaggctctcttctcctcctggctgtgtaattgctctccagagtgggtgccaaattactccagggaaagagaaaggtgtgatgagcacacaccaaaatcaggcttcactcctgtccaaggttagctctgcttctgggtcaggctgggagtcctgaaacacttctgtgggatagtcatagtgggataatagttcatagctgtgcttggacactctcatgaattgatattaatttatacccatgagatgtgtctggcaaatcattttgacactgctgtcaacactgagggctgtctgcctcatgaacctagagaactaatgcagtgctgtatttgcaaagccgccaggccctaaacagggctctgccacaaactcaatgtgtgaccttggctaaatcagccatcccccatttctagtacattctcctttctaaaatgagggaaaggagtgtgactaatttttatcaaaggctctttccagtttggccatcttatagtttatgtaaccataggtaaagaagtgtatcaacttaaaagagcagagataggaggaggttaatgctgagaccaggattgagaatcagtgggatacttcccgaggccaagaaaaaagaggtaggaagcaagaaggtatggcctgttcagtttgaagtttatatgggctgatttccatggagaaacaggcgggtgatctcttgggttttgtgctagcccttgataaagaagaaagccagtggagatgggaattgttttagtgactggttaagaacctttcttaagttcataatgattacaataaccccaatgaggctgaccttagaagttgtctgcgtttaggacgaaatgattcctttgtccctcatcaaatgcctcttttcccagcttactatttacaaaccaaaccaaaaaaaaaaaaaaacaacccacactcaaccaacaaatctcagtaattatattaacattgatagggtatgcttactatgggccaggctctgtgctaagaactttatttccttccaatatctcatttaatcctcccaacaactctgagatagggactattactgccctttttctgcagttgaggaaattgaggcaccagtctgtgctcagagcgtttgtggaaactaagggggataccagaaagtagaggcatgggacagtacattccctaaatctggaatagttctattaacaaaaatcatgtcagttacccaggataaagtcattgaaaggatttgcaggagccaagggagagcacagattgcttgctagtggaaacttttaattttctagcttaaggacaaattttcagtttttagactgtcccctaaaaaacacagccatgacttatctcacaatttatgtagtgtgcctttaacagttttatcgtgtttcctacgattaccatctttcactctctggaaagcagaggggtggtatgtgaccttctgtctccgtaccttcctcaaatgcccggctttgccttcaacatgaaaaaaatggacaccttccctgggggaagaggacatctatttccaaaaatggaaggaagaatctaactctgcaccccccggcctcccgcctccactgccctagccctagccccaagcatggtcacagcagattgctcattcttcaaacgtatcatgttctttccatctctgtgcctttggacaggctgttctcaaagcctctcaatctcttcccttctctgtcaaacaaatacgaattcagccaagatccatcttgtgaaccccactgcccacgcaccccatcccccgacttccagaagagtggatttctttgcctttcctcgggcaccaaggagagcattcgggtatggcatgatacagtcagtacatgcagggcaaaccagcaattaggctactctcttcaactgtgtatcctctccaacacacacatataccacatgtacacatcttacagagtacaatagagtattgcagttaagtgagtgaactcgagatccggacaacctagatttaagtcccagctttgtcactaactaaatgaatgacccttgagaaagtgcctgaaccactctgtgactcagtcatctcaactgtaaaatggagataataataagactcctctcaaagagtcattttaaggactaaatgagattaaatatatgaagtgcacagcacagtgtctgacatatagcaactgctccatcagtggtacccagtattattattgcacagagcttggtgcatagaggatggcaaatacatatttgagtgggtatctgaacacagtaagtctttaggggattaacttagggagaggtcagggacagttgggctactcaaggaagctgttttctcctgacctcattactctctcactgcaccctgttttttccttcactgcatttatcacaatgtacaattattacatgtgtttgattacttatttgatgttgatgtttcccaataaactaagtttcatgacgccagagtccatgtatgttttaaccaccaccatgtctcctgtacctagaacagtgccaggaagatggtaggtgctcaattaaagaattaaaaaataaatgaaactgagttaaagaataaatgaaagaagaattcaggagtgatgtggtggatgtaggtgtggtggatccttttgaaataccttgtgtttttcaaaatggcctgaactgatgtgatggatgtaggtgggcctgaaggataagtaagagttgagttggtaggcaagaaagcttctaaatggaagggaatcctgggaaactccagcacttggtggtggaagatgcagcgaacagggtgcaataagtagatcccttggtctggaagaacaagagactgtttctgtagtgtagtttacataggggagtagtgagaagactggtagggggttgtagtgaatggctttgaatgccaggctatcagggattcattctattagcttaggctttggcctctattagcatgcaaatattcctgggaaaaaattatatattctcagccaagtataagtgtgtataaattagtttacttgctctttgccttagaaaaaaatttgccagaggggaaagcgatagcaggaggccactggaaagagaaaatagtgccccgagataatcaaaagcatataaaggggaaggggaagacaaaccttacttatctccagggttgtgatggtccagaacctgaacctcaaactttctatagtttgtttcatcacaaaatgactcttctttattaaaagtgcaggcaaggaatacgggtgttaaggaggtttttaatcactgaataaatctgttacctgtttataggtctgatgagtgtttgaaatttgtttatcttgattatctaatttattatctatggtttcctgtgtcattaaaaaaatctttgtaaacatcgtttctgatggctgcatgacattctatcatatggttgtcccataatgtaactattctcttaatggttctcctctagttattcacaaggctgacatgaataatatctttgtaccacaatctttatctgtactaccactatttccttaagaaaaattgctagacatgacatttttagtacaaaagacccaaaatttcttaaggttctttcatcttgccaaactgccacccagaaaggccagagcaatttttcctcctcaccagtacatgaaagagctttataatgttgagggtcatgatttttaaaacatctttgctgccaggcacagaaagacaaataccacatgttctgacttatgtgtggaatctaaaacaatctaactcataagaggcaagaatagaatggtggttaccagaggctgggggtggcggtgggggttgagaatggggagatgtttgtcaaaagatacaaagttgcagttatgtaactgacctaaggcttcttcctgcccagtgcaaaaacaaaataaattcaagacattacagtaaagaaagagtttaattgaccagaggcggaagtgttggaggttaggggtttttcaaagataatttcgtgggcagggggctagggatggggagtgcagtttagttggatcagagattaaatcatagggagtcgaagctgtcttcttgccctgagttgcttctgggtaggaccacaggagtggttgacaggtccaggtggaactatcggtggcagacatgcaacgaacctgaaaaagtatttcaaaaggccaatcttaagttctgcaatagggatgtcatctgcagcagtaattgggaaagttgcatatcttgtgaccccgggaataatggtgggtaattgtttacgtctgcaccttagcagaattcaggctcctcttatcctcttagcctggtggtctgtccttagctttacaaaggctatgagttatggtgaaaaactattatcatttaagctataaactaaatgcctcccaaagttagcttggcttaagcctgggattaattaaaagcagcttgaaggctaaaggcaaaagggaggttggccagatcagatctccagtcccccaccacgttgccataattttctcactgatatattttttgcaaaggaggtttcagttgggagaaataaatggtaacttatttcagtaaatgatgtgattgttttttcccagattgcaaatcatccctgtaccacttattgaataatccttccctttcccattgaattgtgatctttcctttaccttataaattcatatatatgtatgtatacacttgtacatatacacacatatttttgctttattttgtttgtaggctctctatctgacccattgatctgcctcttcttgcagcactatcactgctttaaatgttgcagttttataatacattttgatagcattactcctctgcctcaaacttttcttagctatttaacttagttcacatttccagacaaatattacaatcattttgttaggagggccggttcctgcccagagcctacctaagttacatgttttgggtgctgcctaattcatctactttgatcatgagacatactcatcctcataatgagaaatgcaaaagcccaaataagccaggctctaattctacctttggctttcacaccgtctttggctcctaaagggaagtatcaaaagagggaaaatattttgtccacactgaagagctgaaatgaaaaggaatcatttaccatgccaatcgtattttttttattttatcacagaacaattggaatgtaaatcaatcattttcaaagtatatctttccctctgcctgaagtggaattactctctaaagtgacaaacattagtatcttatctatgtatttatttttgtttcattactaacatcatggaattacatttacaaatgctctcagctttgtctctgtgtctatggaaacatgaattacttagccttttggagcctcagttcgctcatatggaaaatgacaataatgactccattgtgcaaaatgcctggctcactgttgaccatcagtaaatgttggctatattatataattatgacaggtagtagagcattttggttcagagtacagcctctggagccaggcttctttggttcaaatcttatcttcatcagtaaatgattttctgatcttggataagttagctaaactgaatgtgccttgatttcttcttctgtaaaatgtgttaataaaattacttgctttattggttgtaagaaatgagttcactctgtcaatgaagagtcaaactgtaaaatatttgaagagatgtattctgagccaaatatgagtggccaatggcccatgacacaagccccaggagatcctgagaacatgtgcccaaggtggttgggctacagcttggttttatacattttaaggagacatatcaattaatacaggtaagatgtacattggttctatctggaaaagtggagacatctggaagcaggggcagaggtgagggggttgcttctaagtcatagacggattcaaagattttctgattgccaattggttgaaagagttattatctaaagacttgaactcaatggaaaggaatgtctaggttactataagggattgtggagaccaaggttttgtcatgtagatggagcctccaggtagcaggcttcagagagaatagattgtaaatgtttcttatcaaacttaaagagtctgttctatcagtcttctttttttttttttttttttgacagagtttcgctcttgtctcccaggctggagtgcagtggcacaatcttttggctcactgaaacctccgcctcccgggttcaagtgattctcctgcctcagcctcccaagtagctgggattacaggcatgctccaccatacccagctaattttttgtatttagtagagatgagatttcaccat[137 bp omitted]gtcagctgtgcctgaattccaaaatggagaaggttataatgaagcatgtctgacatccacttcccatcatggcctgaactagtttttcaagttggctttggaattcacttagccgaggggagagtccatcagttcgttggggggttagaattttatttttggtttacaactctatcaaacatgtagaacagtttctggcatatatgaggcactcaattaattttagctattcttgttgacagtatccttggtgatagtgttattggcgatcttaatccttattatttgggcaacgacacaatcaagaacatattacctcatagcaccatctagtgcttattttggaaaatgccaaatccctttcccttgaacaacagtcatttggtgaggagaatttttaaaattccaattttaggaatacaaaaggagtttggaaatatcatgatttcaaattttctccagcctatctgggcttttatttataaatgtcagggatcttggttgcaaaagacagaaactgactctggctgaatttagcaaattattgggcatttcacagaatcaacagaaaggcaggtaaaccaggataaagaaatgatcaggaatcatgggaggacctcagtcaagatttgccataggaccagcttggttggtatgtcactactggcaacaaccaccttcactgcctctacacaccaccaccacaaaacactgctacatctggactctactgatctgacattctggtctgctagatgcagtttctatgaatgaattcaaaatggccactttttgtataaacctctcaagatccaaagtcttcagtaagagcctgggtcccctatggactccctgaccactcagggcttgtggagagggaatatgtgcttcccttagtttccacagtaagaggcctcagccttgttttccaggctcacaatggaggaatacctcaaaaaagaagagagtttggacatccacatcaagtagggttactggataaaatacaggagacacagttaagttggaatttcagaaaaacaatgaacacatttttagtatgagcatgccaatattacatgcagcatacttatagcaaaaacttgaaaagatgaaaatgcccggtttaagtgtggagggtacagtgagacgagtactcttgcatattactggttggtatgcccattaatatactcaagtggattaaaaatattcacaactgctgaccctcaaatactgtttttaggaatcttcatagcctatgacccaagagctgaattttaaggagtgtatcctaagaaaatgatcagaaataggcaaaataatttgtatgcagagtgctcattgcagttactgttcataaagaaaaattggaaataaatctaaatatgcaagataagagaatggccaaataaattgtggcaaatacatatgatagcatcttatacagtcattaaaaatatgttcatgaagaattctagatacgtggaaaactgacaaagaaatgttcagagataagagcagggcagataatagcatatacaactcactaactgtaatcttaggctacttaacctctctctacctcagtttactcctccgtaaaatggcataataatagtaataagaatggaacttggaatagtgctttgcacataccaagtgttatgtgttggctggagtgtgtgtgtgtatatgcaagtttgaggagggggcagaggagacagagatggcagtcaagggacttttgcaataattgcagcaacctaagtcagtgtttccatgtctcagtctctagtttcatggttgctgagagtcagtttatggtggcagtggtagtggctcagcttccctgggctgcaggtatggtgttctattcttttgttttgttttgttttaattcatcattgtctttattttatagtaggaaaactaaggcatttcatgaaaaatgaagtcaattgtacaatgcataatacagtcaaagatcttgacacagaattggtgtcttaactatcatttctcacctttaatcaataaacattcctctttaaagacaatgaaaaattacttatgttaaatatagaaaaaataaacatcattaattaaacactacatctgtaacctctttacattcattaacactcaggagtaaaaacaataatgatttttgctatggcttcgtgtttctttaaaacattaactaaaatagatttctaatttgggaaacataactaatgctatttggtttttaaaagaattgtatcttaatcatcaagctaaagacatagcaagaaaacaatgacatggtcacttgaagggtgtctcagtctaattttcaccatctaataagacacccttaaagtaattccaacagaaagtctaagaaattcatcgatcaacttcctaagcacatcagggaaggtgctaaaacagtggacatcaagaacaacagcagcagaacatcttatttaaacttttgagataataaaacaatacagaagtgggaacccttgtgaaattttttttcttgttttggttaacaagatcattaatactttacaaacctcatacatgtggcacactgtaaggtttaaagaataaaataagggcctttctgcccatggacgccgccgaagaagcatcgttaaagtctctcttctcccttccgtcatgtctaagtcaaagtctcctaaagagcctgaacagcagaggaagctcttcatcggagggttgagctttgaaacaaccgatgagagcctgaggagccattgtgagcaatggggaatgctcacggactgtgtggtaatgagagatccaaacttcaagcactccaggggttgtgggtttgtcacatatgccactgtggaggaggtggatgcagccatgaatgcaaggccacacaaggtggatggaagagttgtggaaccaaagagagctgtctcaagagaagattctcaaagaccaggtgcccacttaactgtgaaaaagatatttgttggtggcattaaagaagatactgaagaacatcacttaagagattattttgaacagtgaaaaattgaagtgactgaaatcatgactgaccaaggcagtggcaagaaaaggggctttgcctttgtaacctttgacgaccatgactctgtggataagcttgtcattcagaaataccatactgtgaatggccacaactgtgaggttaggaaagccctgtcaaagcaagagatggcgactggcttcatccagccaaagaggacaaagtggttctggaaactttggtggtggtcttggacgtggtttcagtgggaatgacaactttggtcatagaagaaacttcagtgatcgtggtggttttggtggcggctgtggtggtggtggtggatatggtggcgtggggatggctataatggatttggtaatgatggaagcaattttgcaggtggtggaagctacagtgattttggcaattacaacaatcagtcttcaaattttggacccatgaagggaggaaattttggaggcagaagctctggcccctatgatggtggaggccaatactttgccaaaccatgaaaccaaggtggctatggcggttccagtagcagcagtagctgtggcagtggcagaagatttaaattaggaaacaaagcttagcaggagaggagagccagagaagtgccagggaagctacaggttacaacagatttgtgaactcagccaagcacagtggtggcagggcctagctgctacaatgaagacatgttttagacaaatactcatgtatatgggcaaaaaactcgagaactgtatttgcgactaattgtataacaggttattttagtttctgttctgcggaaagtataaagcattctaacaaagggttttaaatgtagatttttttttgcacccatgctgttgattgctaaatataacagtctgatcgtgatgctgaataaaggtctttttctaaaaaaataaataaataaaataagcaagagagctccctgaaattagaaacactgcattataataaacccccccccttttttttgagatggaatctccctctgtcgcccaggctggagtgcagtggtgcaatttcggcttattgcaacctccgtctcgcggattcaagcgattctcccgcctcagcctccctagtagctgggattacaggcgtgtgccatgacgcccggctaatttctgtatttttagtagagacggggtttcaccatgttggccagggtggtctcgaactcttgatctcaagtgatccacccgcctcggcctcccaaagtactaggattacaggcgtgagccaccgcacccagccgtataacttttataggcacacacttccttaagtttcaagcaagttgaaattcaacccttattattcacaaggacttcaaatagaccagtttacaaacaagcatgagcaccctacaaacggctcttactacggagttcttaggataaacgtgtttatactttgaacagtcacgtgagtatcataaagatggcgattgtatatcactttccagtgaaattgcttgccttcctttatgatttcttcagtctttttttcagcagacaaaagattttctaaaaagtctgaatattctaagtatagctcatcacctggtaaaagctagagcatcccatcagcagttaacaaggtgatcggcagccatctttccagtccttctaatgcacgatccaaacaaaatttgtgcaaatcagagagaggcaaaattttcaagtcttctcatttcgtagaactgtgggggtgccagccaaatttcttttgataagaaactttcagttgcctttgatggagatgaccactggcagcccaccacctccgccaagtcggagtagactggcggcggctcgcgcaggcagcataggaagaaggccgcgtccaagaggcgagttgcgaggcgcgagaaaggggtgagccagacgctccagtggtgcagcgcccagatatcgggcgtgcagtcgaggtgcgcgcacagccgcaggaaatggcgcgggtcccgggcgcaagcgggcgcagcaggcggccaggcccggctgcggctggagggcgaggcggggctctggcgcggggccgggcggggaggtcctgggcgttgttctattcttgaagccaatcatcctagcggaggcttcctgatgacccacttttctgtctgagggcagaggtcacagtacccctaatgggcctatttagtgatagagtcctggtagtcattcctacagcccgaggctatagcctgttcttccagcctttccactgatttttgtaagctcttaattccctgtgtcccatccttttctcctctaaataactaagcagtttctgtttctcaccactgaacagcgactaatacaaggatgaaattaaaagttctgtttaggacatgtaaatattctgatacctattgatgtcaagtatgcctaatgtatacagaatctggagtacaggggtaagaccagggtaaaaagtttattttatgcttttttctccttccttttgtctttcatacaaagtttaaatatgtgagtcttaagtatatgaaaaacattaggactgaatgaaatcacctgagcagagaacgagaccagatgctggcccaggacgtatctggggcacactccaacatttaaaagtttggcaaaggaggtgaaaatggtatgggcagctgagaaggagtagtgaataagaaaggagaaaaaccatcaaaggatgtgggatgtatcccagaaactaagtaaggaaagtatttcagggtgtagtgatcaactccatcaaatgttgtactgtgtgtacaaagtgctctgagtgtactttgtactctgagagacagagtccaaagacaaagttacaaaagtgtccatggaatcagaacataaacaagaatggcattgaaggagtgatgcaggcaaaagcccagtagaatgagtagaagagagaatgggaggcaagaatgtggagatgatacatatagacaaccctttgtagaagtttggatacacagggaacagaaaatgcaggggagtagctactaggaagatttggggttaggggaaggtttttggttttggttttggttttttgttgttgttttattttgtttcgttttgttttttttttttgagacagagtttctctcccattgcccaggctgtagcgcagtggcacactctcgcttcactacaacctccacctaccgggctcaagcgatcctcctgcctcagcctcccaagtagctgggattacaggcaggtgccaccacacccagctaatttttatatttttagttgagaacaggctttcaccac[137 bp omitted]tgtttatctgctcataagtacgatcaaggagagaagaagataaactgtgagagccagggttttgagaattaggcaaataaatgcagagttcaaggggaaggcccttgataggagtaaagacattctctgcacagtaccaagaaggaaaacagagaatacagctgcaggtagggtttgttgggtttgatggcagggagatgatagtttacatctaattgtttctattttcttaaagaaatgaaatgcaatatcatcagctgaaagtaagaatagagaggggacactgaaggtttgtagacagtgaaaatggtgtcatagagtcctcacagggaatgacagtgggagagaaaatcgagcacaactgtgtagtataattcttgtacagcataattcacttgtaaattttagtgaaattttttcaggtgagctcttcctcattcattatccccaggtagccactgacctgctttctgtcactatatgttagattgcattttctggacatttacatagatggaatcatatactttttgtcccaaattatttcatgtttaatatgttgttgtggatgttttaatgttgttgtggatgttattgtctctttcttcattttgatttctgattgttcattgctattgaatatttagaatacagaaataaaattgatatttatatatcaatcttgtatcctttagccttgctaacttactcattagttctagtagcttctttgtagaattcgttggattttctacatagatgatcatgtcatctgtgaataaaacagttttgattcttttccatagtttttttttcaagtgagaccagcaagtagagtactgtgctttctactacaatattcagttgtttatgtgcagctagggaatgggggaacagttgggtttaatcacagctgggcttttgaaaaggtctagtgtatgaccaagagagagtggctaatgtggggtagaggaaaaggtggttggaggtgaagaaagtcaaggaagtggaaggtcatggtgtgggatgggtcatccacattgatgttaaagtcacgaaaaatgatggaccagcatcagcttggggaggacaactgagtctggagggaaaggcttcctcagtagaatttacacaccctctgttatgggcttctggggagtcatgggtgcgggtgtgcagaccaggacatggatcctggacactctgggacactgcctcccaaccacaatatgtgcctaggcttgggcatatagctgatccacactcccctcctccccaccctcagagaccttcactctcagttcagctcaaagctctcaataacctagagactttttagaaacaaagtcctctctactttcttcctggcataagtaaagttcagatctccttgtcacaaagccctggccatcctctgtggcaagagtaaaagagagaaagacaaattttgtttagcgatgaacttatagcagaaaaaaacagaagacaattcattttcaattagattatcttaccataccaaaaaaagaaaaatcaaggaaaggataattcccacatattaaccctagatattaaccctagatatttctgcttggtgggaaagtgggatcgctcctgtatacatgcaaagggatggagagagagagagagagtgtgagtgtgtgtgtgtgtgtgtgtgtgtgtgtgtgtgtgtgtgtgtgtgtggtttggggcacatacaagcacaagggaataggggaatatctttgacaccttactgcctgccacttctttgttggtctctcctattttatttaagtcttctgtccctaccctcatattttcctcaggctaaagaggatatccactgtgtgttctatggagcaaaattctctctacttccatccctattcaccagttagctctctttgaggtgacaatggatatgaaagggttaataagattcgaaagaacgtactattgctttagcaaaccactgtgtttcctaggcaacataatgcctgtatttctcttgtttcttcctgtttccaaaagcccctatggagggaatggtaaaaatattagccttggccaacactcaagcccttgctgtttccctctctctccccattctgctcccctcacagttgaccttgcctcctacttcatggaaagcattgaagctgtcaggtttgaattccctctccctctcctcttaaaggagaagctatgatccttccacctgttctttcgatttcatcctctcttgtctcattccatgccacaggtttgattaatatccactctgggcggggtgaggtggctcacacctgtaatccctgaactttgggaggctgaggtgggtggatcgcttgaggtcaagagttcaagaccagcctggccaacatagcgaaattccatctctattaaaaaatttgcaaaaattagccaggcgtggtggcgggtgcctgtaatcccagctactctggaggctgaggcatgagaatcgcttgaacccgggagacggaggttgcagtgagccgagatcccaccactgcactccagcctgggcaacaagagcaaaactccatctcaaaaaaaaaaaaaaagtacccactctgtcctgtattttcaacctctaagccttactacctatcttgctgcaactgaagtctatgatagttttcagaagaacgaaaatcaaaccagggaatccaattccctcttttccctacctcctctgccttagtcaagcttctcaaacttcttttttgagagatagatctcctcaatcctcatgttccactcactccctaggccactggaaccagacttccacccttctcatgccacaataaaaagagtctggcataggtaacccaggacttcctaactgcctagtccaacttacaccttagttttcatctttcttgatccatttacagcccttggcattgtaaacctctccctcctggaaaccctctctcctccctttgcttctatcggaccacattattctgccattttcctaccacttgtggtttttattctcaatctccttggtgggtttctcttcctctacttattcctacaatgttaatcttcccaagactctatcttggccctctttttctctctgcaacctgcctataaatgtcaggccagtcatatgagtaagtaatgcgagtctggttgatgtgtgacaatgtagtatatgccagaaatcacaaagaaatgtgatcttgccctgtttttattttgaaatagtaaccctgttatctttcattttccacttttgatagagtcataggtacaaaaaaattttgattatccacttaattctgctttaacaaaaacagagcaaatgtgataaaagacagctgatacttattctcagcattggggatacagcagggagaagtggggcttctttaggtgtacctgctaaaggaggcagctgctaatcagagatataatgccagatcttctctctctctctctctcttttttttttttttttttttgagacaaagtcttgctctgttggctaggctggggtttaagtgattctcgtgccacacccagctaatttttgtatttttagtaaagacagggtttcatgatgttggccaggctggtttcgaactcctggcctcaagtgatcttcccaccttggcctcccaaagtgatcttctcattttttacgagaacatttttatgtcagaaatacaggttttatgtaaaaatctgttggttaactgcttacatctaatattttaaaaattaaaataatgtgagggtcaaataaacatgtgcttgagccagctgtagtcaccaaggctaacaattttcaaccttggcttagaacattgtgcaatgagccttgaaaagagagagacctctgccctatattctccttgggatctaattcaatgccagtggtttcagctaccacccataggctgttacctcctgtctttacccctccagtctagacctccatcctgagccccaaacccaaatatccaactggacatattactggatatccccaccagaatgctccttatgcccgtgcttttcaaacattaatgtgcatgtgaatcatctggaagacttgttaaaatggagattctgattcagtatgtctggcatactgcccaagatcgtgcattcccaacaagctcccagtggatgccaaagcttctggtttatgaaccacactttaaaacacaatccccatttgcatacaatgtcctttttgcaagtttgctcctcctgctacttatcttctcttgatgaatgatacgccatccacccatgcaaaaattgggggcataagtcagatgtagaaggaatgggagaaatagaggaggaatccaaagctctgtctcatccacctccttaatatttatcatatctacccttgcatttatgtcctcactatcccaacattgatttaagccttcattttctcctgcggtaaggctggtgtccctgctctagtctccacccctccaattgcaacctccatgctcctacgagcatgacactttgaaaaagcaaaatgatctcatgtaaagcatgggctctggggccggagtgctgagtttaaatcccagcactgcctcttactaattgtgtgactttggacaagtagcttaacctatctatgtattggtttttttcatctatgaaaagaggatgataatagaccctcacttgtgagataaataagatttgaaagcaggaaggggaatgacccattagaatatctggggaagagcattccagacaaatggaatcacatgtaaagtgttcatagcactcagtaaatacacattagctgtgacactggccacatcattcctagcttcattatggttggagtgttgagggtaaggagaaagtagaaagagataaagctggacaagtaatctgaggccagatcatggaaggttgagttgcctgggaaagagactctgtgatggagtttactatgtagaaaattgactcaatagtgctcttgggatctacacctgaaatgtaagacaagggagtaggatcgggtggagggagaagctgagcttcagtgcagtcacaatgcagcttccatgaatcccacagggagctctgagcctggtatgactcctcggagttgtccttagatggggaaagggagacaggcctttatatccctgtattggccattcattacctgcaggctgcactaagaaggatctgtgactttgggctagaaagctctctttagcccagcgcaatctcaggaagaggatttcattgcaagctgtcagtcaccaacactttcagcagttggggacctgggagaatgagtgcgtgagtcctgaagtgggggtgggaagtgaaatctgggtaggtatcacaccacagttgggtaaatcatgccaaggactctggacttgatttcactgacaatggggagtcattagaaggttttcctagaatgggacatgctgttttgcacctctgtacctttgttcagaatgctttttttttttttttttttgagacagggtctcgctctgttgcccaggctggagtgcagtggcatgatcatggctcactgcagctttgacctcctgggctcaggtgatcctcccaggtagctgggactacaggcatgtactaccacacccggctaaatttttgcattttttgtagagacagggtctcgcaatgttgcccaggctggtctcaaactcctgggctcaagcagtccaccaacctcagcctcccaaagcactgggattacaggcgtgagccactgcacccggccccagattgcttcttctatctcagtgtttctgacctggattggaatcacttggggtgcttgttcacatgttagaatgcaggtcaaatagcttaatggtaaacagccaaggttggaagcagactcactatatttgaattctgacattccacttactagctgtgagacagtggacaagttccttaacttttctgtacctgtttcctcagccgtgaaatgggataatataaccaactgccttttaggaagagtactcgagttaatccacaaaagggcttagaacattgcctagcaagtaataagtgctcaaacaatgtcagctatttctaaagattctcaggctttcccttagacctattggattagaatctttgagggctggtcctaggaatggacatttcaataagtgccctccccctctccagattattctgatcctcactaaagtttgacaactactggttccccagaaaatttatccccttccttgtccacttggtgaattttttttctttttctctttttttttttttactgataggcttaactggtgccatgaaaatttttaagactcagctcaatgtcatttcctgtatgaaaccttcctagattacacctcccaccatcccttgccaacctcccccttaccatgtggagacctcaaccgcagcatctgtaaccttttgactgtctgtctccccttgctagactgtgagctccttctttgagggaaaggactttgcatccgtaggctcaccacagagtttagcatggagctagagctcaatcaaggttggttgagtggatgtagatgggcaggttcctttggggtctctttaaaatctcagcatgaagtctccagtctctgaaattgggaatgtggatccatatactatcactcaagacatagttggcaactgtagaattttgttttctagtctttaaatttttaaactttttattgcttgttacaataataaaaagagtttatattcactggataaagaagatagcaaaaattacctataatctcacaacccagagataactcttaggtgcatttccttcagatttttttttctgtgcatgggtatttaacataatgggcttccatattcaaactcaattccacaaatatttattgagcacctactacatgccaggcactattctaagcacaaggaatacaacagtgaagaatatagacaaaagcctctgttcttgtgcgccttatgttcaagttggaagagataaaaaaaatgagaagtgatactgtatataaggaagcagtaaatgcaatgggggaaaatgaagcagggaaggaggatgaggagtaggaagaaggtggtgtgagatttgaaagtagcgagggaatgacccatgagaatgtctggggaagggcattccagacaaatggaatgacaagtacagaggccctgaattggaaatatggctgcttgttcaaagggcagcaaggaggccactgtagctgtagtagagtgaccagggaagaaagtggtgagatcctaatgtcttaaaggtaagggtgggtagagtaccgcagatcctgtagggccttgtaggtgctataaggacttgagcttttactctgagtgagatggggagcatctttggatacttaggctgtttccagttttttgctatcatgtatcatgctttgtgattcttctactcaaatctctgttcacatctctgaacacttccctaggggaaattcctggaagttaaatttcttggccacaggctaggaatagtttgaggcttttattgcatattgccaaaggactttctagaaagcctagacccttttacaatataattaagttcaacaaatatttattgcatgcctactatgtgccagacatggtctaggggcttgaaatacattggtgaacaaaatgaatcttgcattctagcaatttcactcttgccaattgtgtcagagtgcttgttttactctgtgcttgccaacaccaagtattaccattcttaaaaagctccaagaaacaagagaaaaaagaacactccagtcatttgaatgatgagaaatggtgcattgtttttatgttcctttggatttatttgcttccttactaggctgaattatttcccaaacattttctagctaatcagccaattgttctatttttctctgaaagctctttaaaacctttgaaaataattaaaaggagacagaaagtttgaaaacactaaaagacttaacatgtatcttgggaaataagtagtccttgggtcaagtacatcggctttaggaattgacttggagccaaagagcatattaaggcaactctcatgttctgaagggggctttttattcaggagcactcttgcttatttccagataacttgagaactgccaccctggaggagaccattccactcagcattgattctgacatgagcctgaatgatgggatgcttttcttcaacaatctctacatcccagtgttagctaatagcccactttattgaacatcaaatctggtttgcaagcatttatatttttaaactgtatcacttcttgaggtcttaagttgcacaagttttctaccctccttgtgaagcaggacttcctttaatccattatcctccaaggggacacagaggtgtagcagaagagacactggactacgataaatgagaattattaatcctccccatccctccatgaaaacactttccccagatttaatagcggttacctttgaggaaagagaatcaagagtgaggagagggacttcagttgtcttctatatcttcccatagtttgaattttctaactttagacaaatattactttgaaaaaacattccagcaggggttatctgggtggggagctaatggcttggtttttgttttgtttttttactctgtgtctctctttattggaaaaaaatgataaaacttttattatataaaatttcccccagttttataaaacaaaatgtgtgtgtgtgtgtgtgtgtgtgtgtgtgtgtgtgtgtatgttgcatgtctgcaagaatataagccaaactgctaatgtatgggcctgatttaagtactgtttggggaacttggagagggagaaaggagtttcattttttactttatacactcacgtattgtttaagtttgttatagtgaacatgtattatcattctacattttttttcagaaaataaataataaaccattttcccccctgaggttaaaagtgacacatgcccattgtggaaaatgtagaaaggtataaggaagaaactaacaatcacaacagttaacattttagcatatttctttccacgctttgttttatgaattttttgacatagttgagttcatactgtatatagttttgtatcctgtttttccctcaagattaaaacacaagcgttttgccatgtcatgatttttggtaaaagaatttaccaaaacagttttagttaaaagaaggtagatttattagataaagtaggaaaatatgttgtcagagagacaaagggcagcctgcaagagagaagccaactgccaggagacaaaggcttgctggaaattttataggatggcgtttatgctgtctgttgaagaggtctttgtgtaatattgataatgccaaggtcgcaatgagctaacttacaggtgtctggtgatagctgggcatgggaagattgtgaattatttgcgcaggaaggctgcatcttggtcatgaagaaagggagatttgtagcttatttgctttttctttttgctatttcatgctcccaccagcctgattccctttccctaattaggactccagaatgatgatatttgaatggccttttaatggttttgtcacaattcaagtgaattaattcgccattttatttgaagtcggacatttaggttgtttccagtttttctgtattaaaaatgaatctctgctgagcatcttagtaatgaaatatttgtctgcgtttctgtctccttgggatggattcctgaaaatggaattactaggtcaaagagcagatttctagaagtgggattaatggatagaaaatatttttatggataataaaaggttatacccaacagcgtatgtgagtctcaccactctctcgccaatagtgtgttatccttttttttttcccttttatctttcctgtagaaaagtagtaggtgacagcggcatctccatgcttttctttttgttactaatgagactgaacatttttcatatgcttattcaccactggcatgctctcttttgtgaactacctgttcctattttttcccatttattgactagaatcttatacattttcttatcaatccaaatgatctctcaaataaatattaaccctttgtcatattagttgcaaatgaaaatattttataagtttattagctttctaaattttcttggccatacatgttaaaagagatagattctaactatagacaagtgccctcagtttgagcctgtttctccatgattaaattgaagagttttgacaaaagatttggaggggctgtttcagctaatcccaaatttagctctgagaaaaatgcctgggcccgatacaaagattgtttggctcattgcactttataatgatttaagaagatgtggggggcagggatggaagcagtttttgccagaaatttttagaattctgaggtaggaagccaatctttactcaagtctcttgcgtgttgggaggaggagtaagttatgtgcaagccaacagaacacttggtggaaaagtactgctctgggctgcagatgtgtgcacggcttggttttaattatttgtttccctctctatcctttcttctcctcccctccccccgccaccagaaaaagggccagattaggacgaggcaaccccttcctccgtggaggtctgcttctgtgcagcctgttagcacatcaaaggccggatgaaatacctaggaaaggaagggaccaggcctaggatccttccaaactcccgcctttgtctgggctccagctcagggttattgtgactgccaagggtagcctgacagactccaaatagaagaacgctgccaaacaaagaaactttcacattattctgaggggggaaaaaagagcaacaagagaacgttgcttgttaatgcctggtgactgagcaaatcagtaattgcaaaagggtttttcggagaacaaacccaaagttaactgggcgatcagattcgtttccccagataatagggagagttgtgcactgactttagcaatcccgggggtgtcggtcccacagcatctgggggagaattggggaagggccatcaaggagagcgaatgggggttcccaaggtgaaaatgagtcgtgtagggctctaacatagaaaatggagttcgaagaatgagtttcctgtctcctaagacagcttggagggcccgggaacggcagggggaagatgaggggcttcagaatgggaggcagggaaaagcctgcagcaacagaaagggagtcggtgtctggcgcgcatcaggtggcggaggggcgctcgcacagagcccggcaatgccgaggccctcccaacgggtcggtctgcgaggagcaaaaaaggggttcagaggagggcagcgcgtgcgtcgcgctcagctataggatggcgcgaggatggcgtgaggctgggctggggcctcccaggtagaactgaggggggcaccgcgcggccgcgggggagcggcgccggactctagaggctttggagggggcctgagggctgcggggcgggaccgagcagggcggggcgcttaggtggcctcgggggaggcggggcttggaggctccgcccctcaggccccgcctcctccccggctagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccggtacgcggccggcgaggggggcttggagacaaaagaagggggccccggcacggggctgggcgggagagaggcgaggcgggagcggggcgcccctgagtggagggaggaatggcggcgagctagggtaggcgggtaggcgggcaggcggagagccgggaggctcccggggcgggcagggaacaagaggcgctctagaggggctgcgggccagtcagggacgcggatccccggcccgcgctgacagcgctgggagggggttagagaaagaaggctgaggcgcttaagccgggggtgggtgggaccacgaagctcgaaggcgttgaggggggacacatcaaagcccaggctgttggggtagttttcgaaggtcctgggcttggggattcctggaaggaggagggggtagtgtcgggttctaggaaggaaatgagggtgttccgagggaggcatgggggagggcgagagtgagaaaaggtccagacctagagaagacgggaaggccaatgacaccgggagtaggtttgaaatatgagggtgtgggagaaaacgccgagacgggattagcagcaggtaaaagctttgtgcccggtggatagtgatgtgtgtgtgcactcgtggtgtgtgcatgcgcggtgtgtgcgtgtttagtgtatgtgatttatcaggggtgtgtgtgtgtggtgtgtgcatgcgcgcttgaaatgggtcatgcgtcaggtatgtgtgtggcatgtgtttggtctgtgtgcgcttgtgctgtgtgtggcagatggggaaaggctggaaggtgaacaaggaggaagggggctgtttgagggaggaataaaggctgaatatggtggacaatggtaacgtggcaagcttttaaggtaatatggtatttagtctatagcaggagagaaaggattagaagccaagaaaaattaaaatggagggagggagaagtgggaggataccaagaaacaaaaggagtagagctaagaagactgctgggtggggggatatcaggaaaagccaaccagagggaaatgaagaatggatgactgctgcactgctgagctgttggagaaggcaggcctgatgggttccttagaggcgaggtttttgcaaacctggttgcgtatcagaatcacctgatgcatctgaggaaaaatacagattcccagtctaaccgccagagctgcaaatgagtctcgggtggtccgggagtctgtattttaatatgcttcccaggcgaatttgaaaagcagccaggcttgcaaagtcctgctttatagaatacttggagatgaggaagaagaggttttggctcctccaatatggactcctctaaacacagggagcttagaggatgtccacatggacggtgctcattccacactggcctgagagagggaagagtacagaaggcagtacacaaactcaggcattcattttagtctcccagtccaactgatcaaaatcagatgtgttaaggttaaggagctcagttttttcttgcagacatttatttattataaaaaataaattttatttattttttagagacagggtctccctcctgtgttgcccaggctggtctcgaactcctgggcgcaagcagtccttccacctccatttcccaaagtgctgggattacaggcatgagccactgcaccgggcctgtggatattttagaatacctgctttctataggcatgtaactgtcaaaatcatttgaaaaccacatacattatttgtcacttagagtagcacacatagttgctttatcaataaacataatcatgtaaatacctgttaatattgagctcaatattaaaggagtgaaaacatgtgcatgaggcatcatcatgactgtagtttgcagagtcattgagaggatgtcagcctgtgcacagagcacaaaactgggagtcaggcaacctgcgttctagtcctgattgggtcatgactagctgtgtgaccttgtgcaaagcattgttctctcagagccttagttttccctctgaaaagtgataaagatggcctattgtgagatctctgtctctatcttgcactgtcattcagtgagcccatgactacgtgacatcttggtagaaagtgatgcttcatgttgtaaaggattcctaaaaattagtcattctagtgcctgttaattctgtgcaaggcactgttgtagatgtgggaatatagcagtgagcaaaacagacacaaatctctgcctatggagcttacgttctagtgaatatatgttgcactgaataatatgtatttttaaaagacttttaatgttcccactagagaacatttaattgtttaaatgtttaaatattctatgaggtttaaatattctatgtttaaatattctatgaggtttgcttggtaaagactcactctaccaagccaatgaccataatttctgaaatggtaaggttcaaaccattgcatttgcctattctcaagcactaggtgctgccatttccactaggggtgtacatttatgaaaaatgtgggcttttttttaccttctttagtgaatgtggcagcatgtaatgatgattaaaaataagcatttttctttggaattttacttgcatttaaaagttgtaaaatttgtaaaaaatttctgagtgtattgaggtttcaggtgaacaggccatattgaaacttgatctattctcatacttggttccctacaaacattttaatgtcagggctgctattcaatctgccttgggggaaacaacacattgtttaaagtacactggattctcttcatttagttgtgcaatatttaaataagtctaaatatccactttgtgtacccacagaatgattctctgctctcttagacaaaagttcagtataatatcacaaataatcacattttatagagttgttttatagagttgttttgcagtattgattcagcctcttttccatgaaaattttagtattttcacagtcttctcaagcccaccaaaaaacagataatgaagactgatctctgtgttatctatttattgacagtgaaggttatgtaatgtggatagatttttaaaccaccgatactgttataaaatggttcttctgcagatgccatgagttaatgtttaattgagccttggaaccaaagatctctataagatacctttgtttcattaaaacatatcagaatatattcataaggaaatgtgttttcatgtacacatcagtgcttattatcttaagaaaccataactctcactggtgtagccccaagtgcctagaactgtcaggctcccagttcaatgttcttgtatgattccctactaccactaccccaagagatcactaaccacgtatgacttttttactagctatttggaaaccacaggagactgacgcaaatgtatagcagtttgatttacttttagttatttaaaagttaaatgacaacaggtctttctgtgtctcctacataatgttcagaatatcagcattactatggtttcctaatggaatttgatattcaaaaatggggctatgttgatgaatagggaagccattttctgtgtataaatcacagagaaattgactgtctaataaagaattgatctttggttttgtttttgaagaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcacttgtaagcatttttaaaattgtgtctgggtcaaatttctaccagtaatggggattcgtggcaggacaatagttattactaagcagcctgaaacttgggtgcattttgataggctccttaatcttggacgcatcaagttcatggcttgaagtaattgtagcagtgctgagtcacttgctatgattgcataccaatttttagccagttctctatggaaacttgggtttctggttttgattttaaaatttttgagagatttgctagattccaaatgaggatttggtgcttggtgtgtcagggaaaggacagtgtccatcttggctacagaaagggattttcataagccctctcttgtagagcttgccgtttaaaagcagcccacatctctgttgaagaatgggagacttgtattctgtgaaacagcttctctttgaatctaattgaacctaactataggcctcatctacaaatgatgcttataatgtgcccagcagcaatggtgtctgcatttttaaaaagaaagtaaaaaggagatgcttgtttctggcttatgctatgggctgaggtctttggggagaaataggaatgaggggttaagttcagattttgagaattcaggaattggtttctgtcaaatctaactgtttaattgtcactctagcaatatttcactgccaagaatttgaataagagtctttcccagcttttatgaaacagtatataaagaccatgagcattatttgaagatttttcatttaaaatgtagttttctatgtgtgttctctataatcagttaaatattacatgttctcttggctatatccaaccattttctttgaaaataatgctgacttcagagagagttctggattaataattagccagatgtgtctctgcctttgagttttggtctcaagcaggctacatataacttccaagtctagaggcaagtttttatactttggaaaacatagttcagttacctaatagagtccctaatttttggcatcataaggatgcctttgtaattagttttctatatgaaaccagtgaattgtagtgtctaacttacaaagctctattttctagggcttgccttcatcagtgggagaaaaagtgtgattttttttttccactttaaggctagccccagatgctgttgtgacacctcagctacacttaaagttggtgtggattccccttaaggcaggtttcccaggagccacctggcttttatttgtctcacacagttccaattgttcccaacggttatttcacacaaaagcagctttagttacctggttagacaggttggttactcctctaattcctactcatattcaggaagaggagactcttggctttggacattcagatgatcgaccctgcattagtttggctacagtgatgaggtggtttgctgatgccatctcttctcaagtcttttgcattctggtttgcacccttacatctgttttctccaacacctccagtcatctcctggctcctttaccacttcctttaaccacccataggtttttctctgtgctgggaaaaacgttctgtctcttgctctcctcttcatctatgagactattattccttcctttcactgtcaaacaaacttcttacaagtttttattcctaaccactacttcatttcctctctataccttcttcctccctacaatatggcttctatccccacaattggattgaactctctttctgaaagattttcagggaaaccttttttttttttcttgccaatcctgacttcacttgtccattccatgttttagatctcctgtcatgtgagcctccagaatggctccctccacagagttcccattttggtccatgggagctccaattttcacttaattaattcatgcttccagttttctttcaaagtacttctcatctgtccctttccattcccctggacaccaccctgctcctggcgctggttcctttgcatctggatctgcactctgcctctggatcgccctgttcccagtctctccttactgaaatctgccctatacaccacattgataatatcgttgttaaagcactattttactgtgtcattccttcgcttataaaccttcagtgccctttgccacctataagtccaaactcaggctggcttttcagatctttcataatatttccccacactacttagccaatcttatctcctactaacttctaaatgttaactctactcctgccaacttggtctcttcattgcttcccagatacgttgtctcacctgtatgcatttgtacatggcgtttgcattttctggaactccctccctaaatccttctatacatttttccaaaatatatcctccttccatgaagtattctgtaacccttctgatgaactcatcacttgcccttgttcttctaaacattccttacacacaaacaattcattttgacgttaccttgcacactcattgccagacgttgccacctgttttatatgtctgtcttctgaacaaaacaaattccctgttggcaaggacggtggtataaaccacctttgtatccttcaagaagcccaacacattgctgagtatattgcaggcctctaataaatgctttaaattgaaacgtggtaatgatgttttagaaagaatgagaatgaccatttgtgttttcttctctacctccagtcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccactatagtgtggtgacttatttaaatttttttaaaaaccttattctagggaatctgattcagacattttactttggcttaaaattcagtttcatttttgagtgcagagtttttgtattccaaaagaaacaaggggcaaaatttcatggagaccccacaccaaaaaccaaataccagcttgtcctgtttaagaaatagtgaattgaattgctttttttgtgacttgtcaaagttttgcctaaatcagaactttctaaactgtaaatggcagacctccaccttgaagtctatagcaaggttcttaagaagtaaggttactgaaggcattgtcattgccaagtgctaaggaagggtttgggtttttttgtgttaatgtattgtctgatcaggaaagtatcaggaatccttacagtagcaaagttaattcacctcgtgtcaaaagaagcataacagatttgcatatgcagtcagttgtataaacaaagacaacctattagtgttttgtcattttaatgttaacattggcagagttttcttataagagatatacttcctgaaccaaagaaatttccatttttcatgttatcaaaccacattgcaggtacttgtgagttttttttaatgtgctctttttttttcccacttggtttcattcaccaaatgtttgagtgcctgttttgtgccatgtaacctgttatgccttatgctttggagaaggagtgggggagagaagttgggcccaccttcgcagcctgaaatctcatgtgcatgtgaagattaggctactcattttgcaaagttaaacaggcttgtctgctgccaagaggaaaatatccagagcaagcttgtccaacccatggcccacgggctgcatgcggcccaggaaagctttgaatgtagctcaacacaaatttgtaaactttcttaaaacatgaggttttttttgcaattttttttttttttttagctcatcagctctcgttagtgttagtgtattttatgtgtggcctaagacagttcttccaatgtggcccagggaagcgaagagattaggcacccctgatttagagcctcactaaagtttcactcccaataacctgattctcttccattcagagctgaatcaacattgtgttggttacttggaaaggaatattgctgtaaggcaggactttgatctaaaaacttctcaaatccagctagcatatacataagccatattcatgtaaaaggcaccattcaagaagatggtggtgtcggggggagggggggtagttgttacaaccaccacatgtccagtgaaggagggaggtgttaggttaacatctggcttgctccccacctgctgtcatcctaccagctgcagagacagtttgttctcaactagcgtctgtggttcataagcagcatttactacgtgttttcagtatctgcatatctggcttccctgcataatgtaacattcaccttacttcagagggccaaatttatgcaaatcctagatcaagaacaagcatcaatacatttcttgctgtttcagaaagagctctttgaacctgacggacgctttcagctctaaagtgcccagattttactccaaggtagtctgcctttgttatgatacttagaggcagtttgctgtatatttcacatgaaaatacagttaactcttgaatggtcaaagactgattattgaggcccctaccttctctgactagactgtccatcccaaacccataattgtttttgcacattgtataacttgaacacttccacccagggctgaaggaattaggtgaaattccatggagtcaattttgctacctcttattagcactgataaaatgtgctaaagggaggatcatcttaaatctaaataacattatttcggtttgtccaaaatgaaaataaaactatggtctttagtcccatgaactctgacaatgtcagtttccacaaaatgggaaaagttgcatagaaatgatattaaaattaggcatctatatttccacagaaaatgttattgtggatgtgcaacatgctagccaatacatgtgataaatgaacaaagaatattcactatgataattttatttttaatatatctgacaaatatgtattctctaacaatgcaaatgagaaaagagatcagcaacattagtgcaaagcagcatactgtaagtaggaactttcccccaaaggtggacttatcagcatttatttaaaaatgactattttaaacaattttgcaacaagtaaaaataagtttatttgattcttattttcaaaattaccaggttacatggctttctacctgagaaatttaaacaaattgaaagcacattgacatatttttagtttttttgcataactaccaacaactcataagaaaaacatgaaaataccttaagacaaagtttaaagctcaggcccttaataggacatagaaaaagatatgagaaaacacttttgcaccacttagcacaacaaacaatagcagtgttaattaagaaggtggttacaatattttagttgtattttactccttactaagccattcaattaaaaagtacaggataagttatcttcctcatttagggcctacccaccaaaaaggttgactctttataagacatatacaagtctagggttatacaaaatgtaaacataaaaccagtatttttactttcttctaagtcccaggatggtatttagcaaaaaaaaaaaaaaaaaaaagacaaaaatgttatatagaaatagcaccggttctattacacataaaaattgcacatgctgtattctgcaatttatttttatgtctgactactgagcagcaaactgttttcatgtctaaaaactctgcaaagaaaaatcaagtgacagaacacagtgagatttttttcaaaagcatagctgcttctcattacaaactcataatattctttgttttaatggcatgacacatgaaaaattaagaggcaggttttcgtcaaagaaaaataatacctggttactgaaagttgcctgacaaaatacaagctgttagcagttcaaaaggctactctggacaacagtactttgaacattaacattcaaggcacttgccccataagcaatgtttttcagatttgacaagccaaatctagttttgatggaagagtcactggcttgaaagtggaattgaacacaagggagccaacaaatcatccactggttattatcttattaataataaacatcatctgctatggtacattcatttctgacttcttgcatgtactaacatagctctatgattagaagagatcgatgaaacaacttgtggctcttccttcagataaataagcttttgtagccctttcacatacccgtttgctcaaaaggctggttatatgcacacattgtgatattctgggcaaccacaatgactggcattctacctggctctatcagctggtacttttctacagaatgtcaaattaagagtgtttgaatgaatcatgtcacatcaaagtgttgccctttactgcttctgtggattaaaaatgactttttcctgttgctgacagtctctaatctcattaatgtcttcaattaccaggtcaggcatagttttgttggagaaaaaaaaggtaatcgattgcccctgaggtcctaaatgcaaggtaaggcagaatgaatcagcggagctttctataaaacatgcactgcactaagatgtaagtctttaagaatccataaaatatttcaatttaaaaacatttatgaagtcaaaaactagtaggtaaaaagatcaattgcttatgttgagagtttacaaatcctacacatatacatttttccctagctacaaaactataggcttttctctttactctttttgaaaacttgatggcatcactgaggattgagaagagaggcacttgttactgtttaataaagttcagtttgggggatattcagtgactttacaaactgatgtaatccagccctgagtgaaagggttacataacctgaagtggaatagtcacagcatcttttttcaagtgacatcattggtgccccacaatttttcaatatttccttttgcaaattccagtggttatattacttcaatcttgctgtttttctaaaatggaaagacatggggttcttaaaaaaaaaacaacaactctgctaatgggtttaaatactatccatttaaacctcaaaggacaatctggaccacttttagattcttcttccaagactttgtcttgaaaaagacaactctttgagtatttaaacatagtaataagattaattttctcctggtgggtgctcatgcaactctttaatgtcatgaagaagtctatgttctaactgtcgtctcttttatctacaattatttctaaataaaagtcaggaaagtttgttgctgcacgtggtgtttctgaccaaatcaaagaacatgtaaaaggatcattattcattcactgctgtcgtctttggagataaatgacactaaatgatgatgttatgacacctaaggagccatagagggccatctcaacccctctcaatgttaatctgctccttcactggcgtagaagtaaagttttagctgaaccatagaaatgtctatccttggatcaagcagcatttaaaagcttgagcagggtcaaatacaaattattatttctcttgccaaagttgaaagcataggtcaaaatgactccaggtgtattgacaagctttgggaaatataaaacacacaggttctgaagtttttaatgctgctgtcttcctgtgtagttgttaattacatggctacatttggttttaaattttcttcttgtaacatgtttattgtgaaaaaggatactcctgatctaagtggtcatcaaaacatttaaaatttaaagaaccagtgcagttatttcctgaatagcttccatagtcaatatactcctgaccattatgtctattatagtaataatcagaattgaacttcaaatagttataattacatcctctaaatcttgaattctggttatattctgacttccaaggagtccctcttcttccgtgaaaattaccaaaatagaaagacctagcacttcttgatgacattacgggcacctgagagggcccatagttcactttctggtccaatgtactatcactaaacctctttagataactggaactgggttcctggtagtagccttcatcaaacaagtatctgggggctagttgtcccttcatttgtccattgttgttttcatgtctaatgaaatgactttcacccctaggccatgaacatatccatctcggttcatactcagacttcctacctggtgtcctaaacttgtaattagagtatttttcctcaccatcacgcttccactttgaaaaaaaggtctgctgactcgaccttgtattttgtttgcgagtgatcattttgtcagtgtcaagaggttctttttctgagaaactattaaatgtggccacagatttctctttctcctctttgtttatactaagggtttcactgaagcattcagaatcactactaatttcctctaagaaatctgtcaactgtaaacctaagcctattgactcatggggtggggacacttggcttttccttgtggatttggaatcttcaatatgataactatgagtcttttccaacagacagctgtttccatcagttggggacagctgaccaccagctttatgggctgtctcctggcaatgagtttcaaacccattagtacattctttggcataatctacttttcctcgtttacgctcaggatcctgagtacaaatctttgatgagtaattattttcttgaacctgttctttcctttccaggttttctacttggctcgaattgattgagtgatgcctacactttctcaaattaatctgaaatccatctcccttagcttggacatccctctgccactgacatgtgcctgctacctgacttgtttctaggcagatacgagtatattgtggaggttcataataattgaaaagatagtcaaaaaatgcatctgtttcatggatcttaggtttcctgccttggcctctcccagataatctggaacaggattcactagaaccgtggtggtcttcattttcaagagactggccttcaattatcgtaatctccaaggagttatgcttaaaaaacaaactgtattcatattcctcatcatctaataatattccagctctctgttttctaggggaataccttaaattttcttccccaaggcagtgggaagatttctgtaagtgatccctagttgttttcttcattttttgtttttgtttattgtctgacttggcaacctgacattttgacatttcctcttgattttgaaggtacagagtgtttagctgttcttccagagttttcaatgtgttccctggagaatcattagctttggtgccaataatgtcgacttcctgtgggttaaactgtatggatcccttcaaagaaaaagattaaaaatctctcatgaaaaactaaacagattaaaaaattccaaagaaaaattgtgctttctgacattgttctgaagagacttccaatacctgggatagatccaaattaggaacaatattgcactgaggaaatagaaggcaaaattaaatgtcttagtctaatatgaactgttttgagtaggtctatgcccatgcttatgtgagaaggcaccacactttacatagccttcaaagcacatgactcttttttcacttgtttgaaaatcaataagcctgatgttccaggtattgtgctaggagctggagatacaaagaggaataagaaattatctatagccctcccagaaaaatcccagtacaagaaaagactgacaggtgaatcgtatatctaaaagggtccactagcttaaaagataaactgtctttcttttcataccagcctcttactgtggactgcaggtaaggctgtctccgagtttcctccccattcccctgtgctcagtaagaagcaaggtagcaagtagcaaatgtggccgtgatcgtggttctatctgcaatcatgtctgcagtgctatctgctctccataactgcacagcaggtgaaaggtgctgcccacaggccccaccctgctggaggctttgtactgtgctctcactgacacctgacacacatcagagcacagtgcctacacactacctgggattagaacctgggactgcataatgggtattagtatttacgaggccaagaatcagacaccacacacattgaaaaagatagattctttaggagtcaccctcagaggtcattaaggaaaatgaaaagagatccagctagccttattatcaataaaaatgtgacatttttctgatcctaatttcactaagtttgattgtccacactaatgagaaagaggtcaagattgcaaatatacataaaagtaactctgtgtaatcctaatggcatttactattcatattttaaaacactgaatatggatttttaaatgaacactttggtagcttttctggcttttaatccaggacatctgcagaatctggctatctttaggaggtcaggaagggggagaaacaccttccaaaaatgaaactctccaaacataacaattgctctgtgaggtgagaaatttcttatcaaatagtttaagactagattatcacgagcttgttacaaggctcaagactctaccaaacctactgcagatgagtggaaaagtaaagttaataacacctgacacccaccccccatccgtttcttccctctggcatttttctgttacatccattaggaacttagaaaagtagaagcattagctaaatgctctgggtaatactgtcctgaagtttagagacacaaagagagagagaatgagagagagaaagagagagagagtcaaatggaaggttgggacgcaactcctttagagaatgtggatatcccttttgtaaatctatcggattgttagaggtcagcctatttaaaataagccccagtggatgcaatgagtcttccatggagtgaattttcaataggccactgctcaaatgcaaaggtaatgtctcagaaaggtgagtacctaccaaacttgaagaacaattcggcaatagccttcctgaaattttcctcaggagtacccttaggaaccgaagtgcctcaactcacctctgagccactaggtacttcctctcctcccactcctctgaagagtctggctcttgaggtgcctcagctttggctttgggcttctgtttcctgtgccggtgtctgtctctttccttcagggcttgtctccttaccctggccttcttcctctttactcggactttttgctcatcatcttttctttttctggacaatgattaagattaaaccactcagaaggtatttattaggcatttgatttcctccctccctcccactgccaaggaagaacagatcatctcagcttccaggaatccaccactgttaaccccagtgcctaacatagacaattataataaaaaaacaaaacaaaacaaaacactgttaagcaccagtcaaggggaaagacacatcattttcttagtcaaatagaagctgtaaaggaggccttctgcagagatagagtatcaaataaagaaggctacagaattcaaaggaggggcctttagcccccacattctcaaaccacaagcagggatcacagaatccagctttcatggagactatttcatttttcttgtgaataaaacctatgagttggtttcaaacagacaaaggtgagtcaaaatactcagaaaatcttcagggtaagaactggtccttggtacatattacttaacacagcacactatcagaaaaacatactggcttagaagaatatgggctttttttctgctgttttctgaaaattaaaactgtcttggttaggcccttatgggaacgtggggaaagggaaagaagggacaattacctaagtcagaacttagccaaaactcagaggattatctaaattggatgtttagcctggatttgggggggactagttatatttactaggctcaagctctggccaagtttcacagacatgacctcaagtaattcctatcactccactagccaaaaaagtaagggacacatggaagggtattctttatctcctttttttttgagacagagtcttgctctgtcacccaggttagagtgcagtggcacgatcatagctcactgtagcctcagactcctgggcttaagtgattctcccgcctcaccctctcgagtagctgggactacaggcgtgtgccaccacgcctggctaatttttttttttttaatttttgtagagacagggtttccccgtg[134 bp omitted]ataaacatgcatgaggaagggccaggaagtaaaattaattttcaaagctctgtagttttggctcaactgtactcgactggcaacctttggcaatccaatagccccttctagactcaaactcctgaactggacgtcaacgataagctcaaagaaataaatacaaagaggccgagtgcggtggctcacacctgtaatcccagtattttgggaggccacagtgggcagatcacctgaggtcaggagttcgagaccagcctggccaacatggcgaacgagaaaaatactcccaatcaatccatgccttcttgcatacaagttagcttggttattgaacattttaagaagaaattccatcccagcactaaattcttaaaaattttaaattagtaggctaggtaattttgataatatttggtaaactggtaaaattcttaacttggcaggctaggattttcactataaaagtttcttgtccctttttaaaaaaatcatttctttccagacatcttaatctagctagttccatcattcctcattatttgtcctccctgacaaacatatttttttttgaagtctcttgttttcaacagttttgccattttggttttgtaacagcacagctgaaagactgtagctttcagtggcgttttccaatctgctccaattcttgccccccatctcaatgttatctaccaagtctggctgttcatccaaaaggattaatccataaatcaaagaaaaaaaatctttgttaaagttggtccacacacctttcagctacttcctcttctcttttcttttcttttttcctttcttcttctagttcttgtaattttagcctttcctgatttctcctccttatagctccttcgctgaagtgcttggtcgtatcagacgtaacctgctccaaaacaattcaaagtttcattagaaaagtttgccagctggctgggtacgtcccaggtcagagagataaaactaagatggtacatggtaattcaaaatcaattgaattcaaaacgtcctcactgcatcccagtattcatattcctactgcttctcagccaccagccaaacagtgctcgtaggcttgaggattttctttggcagaacccttgaataagtatatcaaatcatcaccttaactttacacaattttacttgtcagtcgtacctcaataaagctgtttaaaaaaaaaaaaaacctgaggagcttactttacatatggtcatagacaccatcacagtgccatcgtaggcacaggctgagaaatgtcaatatattacttctggttcgttaaaaagatcaaatgagctaatgtatttttttaatcatcagaaacaaaaataatcagaagtgtgtgtggtgcagggggagcaaagatgcacaaaaactaacctgatgagagagaagatctatcatgattagtaaacaacttttcaaatcttgaaataaagtgaaaattagattgagatactacagaatagtataaaataggttaaaatttttggttaaccaaatcacaagaaaattataaccagacactggacagcgggaagtggtctctcatcttgtggtaatgttttatttattatttatttatttatttatttttgtttatttgtttgttttttgagatagcttcttgctctatcgcccaggctggagtgcagtggcatgatcttggctcactgctacctctgcttcccggctcaagcgatcttccagcctcagcctcccaagtagctgggaccacaggcaagagccaccacacctggctcattttgtactttttgtagagatgaggttttgctatgttgtctcagagctcaaaatgatccgtctgcctcggcctcccaaagtgccaggattacaggtgcaagctaccgcacccagcctaattttttattttttaagctgagcagtggtacatgggtggtcatgacagtatttgctatatcatttgcctgactgaatagctcataatttaaaaatatacattttaacttagctagctacatatacacacatgcacatacacacatgcacacacacacacacacacacacacacacacacacactcatacactggaagcagaaagtccaaattcatgctaaagactgatttacagaaaaaggagagtttagttgcatcttttccactgctgggttaaaacttcaagaaggagatgacgaaagtatgtagacatcaatgagatgacatgatggagtagacaggctgattttgaaagtaaagaatccaagtttgttaggattatgtttagcagtttatctgagtctcactcttccatccaggcctgcgtgcagtggtgtaatctcggctcactgcaacctccacctcccaggttcaagcgattctcatgcctcagcctcccaagtagctgtgattaaaggtgtgtgccaccacgcctggctaatttttctatttttagtagagacagggttttgccgtgttggccaggccagtctcgaactcctgacctcaagcaatccacccgcctcagcctcccaaaatgctgggattacaggcgtgagccaccacacctggcctccatgtggtttcaaactgcatgtattcctctcttcctctctctcagcaacttgtcaaatataataagcatatgagataattccataggggccatgaagaattctttaatgccctcaagtagttgagacagaacctcagattataagaaccatcactttaaagtcatagctggcagcatgcctgatagcacaagaatgagtgttcaaatcaggatttttttcttcctaaacatccatttattaaaaataataaaagtctttatatattagttattgatcagagcctggtagggtctaagaaaatttattctagatgcttccttccagcttttattcaggatcacctgaacagtggaaaataaaagaaactctggctacttcttaccttaatgttacatgccagagctttcccatcatttcctttaagcatcagtttcattcttcaaagggactccatggcttttacaaagtcagttgcctcttgttactgtatgaatgcctcaaatgtctgtaagccaaagctaaaacccccaaagctcctgtcagtcatcacttctctgtaggggccaagcataaggatatccacattcttgatcttcccaaaactttcaaagactacccaaaggatctcttcatatggcttctctttgctagaacatttaggtgcaaaccatttacagggcaactcttcaaaacatatggaatctgggctcttctcctgctcttcagccccatcactcaacgagggctctttttccttggggaagtgctcccattctccctgggcatctgtagccactacttttaagtgttttttcaaaccatttagcttgataatcttcccatgtaactttgccttcaggatctgaaccaaacttcgggtttcagcctcaccctccaattgaatgaagtcctttgtactcttggagagctgaactgtggtgaactggtcagggcaaatcaggctcttcagctggtcaagaacttcccagttagagaagggccttacaggttctagactccctggaagcaatatgttgatcaacaattttgctatgggcttgaggtagaggtgctgagctgcacagagctctgttgcctcagagttatcatacaccactgtgactgtcatgttgtcctcagaccaccttagagaacgaaagagaaaattttgatacagatggagtaatacacagatttggattgtgaaatggtgctggcattgctggacttagaacaaattgataaggaaagctatactacaagcagaattaaaataatatcttctgattcccggaactaataagttatttcagcagggcttcagaatataaggttaatacaaaaaagacaatagccttcctatatagcagcaacgaacaagtagaacttgaaatttaaaactcaataccatttacattagcacacaaaacaatgagatacttagttagaaatctaacaaaatatgtacaagatctatacaaggaaaagaaaaactaaatatgtggtccacgaataagaagactcaagatgtcagttcttgccaacttgatcaatagattcaatgcaatcccaatcaaaatcccagtgagttattttgtagatattggcaaactgattctaaagtttatatggagaggcaaaagatccagaatagctaactcaatattgaagaagaacaaagttggagaactgacactatccaaaatcaagacttactataaagctatagtaatcaagataatggtttggtaaaagaaaagacgtatacatcaatagaacagaataaaaagcccagataggcccacataaatacagtcaactgatctttaaaaaagaggagcaaagacaatttaacagagcaaagatagccttttcaaaaaatggtgctggaacatttaaacatccacaagaccttgcgtattgcaatgactttttagatgtaacaccaaaggcacattctagaaaagaaataattgataagctggatttcattaaaatttaaaatttcttctctgcaaaacacactgtcaagagaataaaaagataagccacagaccggcagaaaatatttgcaaaagatatgtcagataaagaacggttatccaaaatatacaaagaactcttaaagctcaacaataagagtacagtctgatttaaaaatgggccaaagccctaacagacaccttccccaaagaagaaatatcagatagcaaaaaggcatatgaaaagatgcttcacatcatacgtcatcaggaaaatgcaaattaaaacaacagtgagataccaccacacacctattagaatggccaaaatccagaaccctgaccacaccaaatgaggtctccttaaggaagaagcatcacaatgagcatgtggtacaacagaaactctcattcattgctggtgggaatgcaaaatggtacagtcattacagaagacaatttggcagtttctcacaaaactaaacatacttttgccatatgatctagcgatgcgcactccttgttatttctccaaaggaactgaaaatttatgtccaaacaaaaacttgcatataatgtttatagcagctttattcataattgtcaaaacctggaaggaaccaagatgttcttcagtaggtgaatggataaataaactgtggtacatccagacaatggattattattcagccccaaaaagaaataagctatcaagccatgaaaatacgtggaagaaacttaagtgcatattcctaagtgaaagaagccaatctgaaaaggtgacatactatatgattcctattatataacattttggaaaagacaaaactatggaaacagtaaaaagatcagtggctgccatgaactagaggggagggaaggatgaataggctgagcacagaggatttttagggcagttggagctatgctgcatgatactgtaatgatggatacatgtcattatacatttgtccaaaaccacagaatgttcaacaccaagattgaaccctaatgtaaactatggactttgggttatgataatgtgtcaatgtaggttcactgattgtcacacctataaccactctggtgggagacgttaatcatggggaaagctgggcatgtgtaggagcaggagtatatgggacctctctaccttctgctcaatttttttcttttttctttttttttttttttttttttttttgttctgagagggagtctcgctctgtcgcctaggctggagtgcagtggcgtgatcttagctcactgcaacctccgcctcccaggttccagtgattctcctgcctcagcctcctgagtagcttggattacaggtgtgcaccaccacggccggctaattttgtgtttttagtagagacagggtttcaccatg[137 bp omitted]aaaataaagcctattaaaaataataatatctgttctataagggaataataataataatatgtaatatttacttaataatatttaatgttttttagagttttcaaagagtatatactgtgtctcagtttccttaaccataaaatagagataataagatttgggggagaattaaatgagtgtgtacaggtgaaatccttagaatgtgcctggcacacaggaagttctcaataaacataagttataatattatctattagtggtagtagtcttactttatctcatttgatttatgaagcaacccgtgagtaggtatttgcctgcctgttttacagatggggaaattcagacagtttcaggaaaattaaatgacttgcccatacattgagaagccaagattttctaaatctctaatctattgtacaattgatcttaaatgtaaagttccattaaaaatctgctggggatggtacacaaacagggcaagggtggcacattaatgaacatgcaccgaacatacatagaacttatagttctaacccatgcacctgacttagcatcccttgtccacgttggtttccaagtctaaaatggacatatctactcttgttcctccagtctgttgactttaactaaattgatctctaagttaaagttaagaagagacagccttttctaatgagtgacaaagtgaatttgccctctacttggggactggaaaaaccccaaaacatgagtgcttcctgtttacttcatattaacaaactctttgaagcagtactaaggtgaacaagatcactaatgctgggaattagagatttaagcttctatttgcttactttaaatagcacttcctaataaaggagtttttttctgagcagatatattcagactctatgtcaccagaatttctcattaacgtcaactttagggaaatttagagccaaacatatatggccagatgacagaaattctaacacaaaatttactgcgaaatcttggctaactttataggtacagaattatttaataactacccttaaaggacaatccaagttaacttcctttagaaggcaaggtttgtagagactgattttataaaaggtcatcaaaagcagtatctaagatactatgttctagaaacccttatgacagcaacactgaaatgggatgatatgagaagaaacatgttttctttctccaaaagcattatctatgtagcaaaatggaaaaaatccagttagtttgctgcaatttgcaataagagtcaacactaagccccctctaggagaaaaattaatgtgatattcaattaagatatactgaactctaaaatttatttataaccattaggtatttatttatacaacctaatataaagcaatagtttttttaaaaaaattccagaaaatattcacccaaaacagaattactctcttcaaagtaatcaggtttgtcaagctctccacttgctccagcaatactgcctttgtttaaaacactgtagaatgcttctcttggattgatttcaaagcctgggttacattattttaagtagcttcatggaggccaatttctaaattcctttatcatggatttgatatttagaaattatcacaaattatgtataatcaagaatgttggataaaatggatgactataagaacaaactgattttcccaagaagacccaattgtttttgaaaaaaaaaaaaacaaaaaactgacctcctttaaaatcctcacaacttaaattcctgtttcccaaggacaaaaatgacaagaaactgaggcatttgttcttctcatatctttcatagtggttcacaggctttagatcttaaaattgaatgtcaataaatatttcatcttaaattactctcccaaaatagagggctaattctctaatcttacttttaaaaaatattgaggacctagtatgaccaagaagtaagctttttatatacggcatggcttcattgctatagaagtgtcattggcaacttcttctaagtcattaaaaattaactagcatagtgactggtacataggtgcacaacaaccaactcccattgtgatgcttcttccttaaggagacctcaagtcaaaagctaataaaatatataggagaagaaggaggaggaagaggaggaggagaaggaagggaacagagggagggagtaattttatttttggatatttagtgagtacaagtgcagatttcttacatgcatatattgtgcagtggtgaaatctgggcttttagtgcacccatcacctgaatagtgcacattgtacccaaagggtaatttttcaatcctcacctccctcccacccttccaccttttggaggtagggagggaggtagggagccagacagtggatctgtatttactgacaaaaaaggatgcctgtgatagtttttagggaaaaaataaaaagcaagtgacagaataataaagtaacatatgatattgctcttataaaagtaatataaacacacatggccatgcacacagacataatatataatgtctggaagaatatacatcaaattgttaacaatatttcccctagaaaatggattgggactataggagaagaataaactttccctttttattaaatactttgtacatttcctttttaaaaatttatttttatatatttagagagtacaagtgcaatttcttacatgcatgtattgtgcagtggtgaaatctgggcttttagtgcacccatcacctgaatagtgtacattgtacccagtgggtaatttttcaatcctcacctccctcccaccctcccagcttttggagtctccaatctattattttactctatatgcccatgttgtacatttcttaatgcttcagttttttaatgtttacaataagaatgtattaattttgtactttgtttaactaaaaagaggaacttcagatgataataacaagctactaaaaggaagcaatttataaccgctgacaccaacttgtccagaaaagggtaaaaaaaacagattaatacaatagcaactcccttcacccaccaaaagcacccctctgtctgccatctctgtaaatgcctataggcatttgaacccatagtcaaagtttgtgtgagtcacgatggaagcctgggagatcagaacaggactttgaatatcacaggctcacttggcaattgcaatactagctacacaatgggctgcagaacctatcttttagaactgctttattgaggcaaaattaatatataataaactacagatttcataacataaactacacatgtatcaaaactgtatgttttgataaattttgacatatgtatacacacctatgaaactatcactgcaatcaaggtagtcaaaatacccattgtccctccacatttcctccctaccctcatcaatcactgatctagctgcaaaatattttgttttgagacaggggtttgttctgtcccccaggctagactgtagttgtgcaatcaaggctcactgcagcctcgacttcctgggcgttaagccatcctcccacctcagccttctgagtagctggaactacaggcacgtgccaccacgtctagctaattttttattttttgtagagatgggtctccctatgttgctgaggctggtctcaaactcctgggttgaagcaatcctctcacctctctctcctcagcttcccaaagtgctggaattacaggcgtgaaccaccactcctggcttagctgcagcgtttaactcataaatgataatttataacacagcaaaagcaaacagatgtttttggaaaatactcaactagtccaggcatggtggctcacgcctgtaatcctggcactttgggaggct[135 bp omitted]gaggcaggagaatcacttgaacctgggagg[132 bp omitted]ccaaatacacaaaaacataatctatgcttagttattatactgtagatatagttatgtattttatgcatatttatatattcatcaaaatatacataccaaaatgtgtggaatcactaagatcaaattattaggctttgacttaaaactgactctttagaacaacttaatttgtctctaatttcccttttaattagcctgtgcttcaattgaccgtaatggtagaattcattaataactttcccatcattttcaccaatcactattatatgcatagattaatttattaaacaaagtttcaggagcctagataaaccaagccttaatggcaagaaatgccataatcatgaccttcacaaattatcaaaaagtcaaattttaataaatatttctagtattcccatattctattgtgttcaccataacctccccaatcctccccacccacatgcacatatctttcctttagccttatgattaaaagcaacactactgagatgacttattctttaatatctttgcataggaaaatgggagctcctctaaccttaaaaaattatagttatttaataatgtttacacagtgtgcattctagcagtatcttgtgtacgtagcttcactaaaacatttcactcaacatgttcccaatgccaaaacatttctaggagattctcagagaacacggtcacctcatcttccttgcctctatatctcgtagcaaagttgattgaataacagtaggataagggaatagagaaaaggaaatagactggagatgttgtcacaagcctaaaatgtttattttaaccagcagtgaaacctcagtaaattctgcacagtctgcatcctaagacattccaatatcttctcctgtttcaggagatactggagagattcacctaatatatctcaggatttttagatcagaaatataacttgaaactttaaaagcacttgagtaatcagcaaagtagccacctattcattctctcttgcttgttctcactctcataaatatttgctgtcatagtattagaaaggccatttgaatgaggtacttaaaaaaaaagtggaaaaaataggaccatctatgcaatcaatatcctctttcaaagtagctctttgctgcctttcttttttctccaggcttttgaattttaaggttagtcattttgaaaacatttaagatgtatgcaattatacaacatatttatggaaatagcagggaagccagaatttatttgggtcaaattaacctagccaattttcaattttctggctactacagaatcccagtatatcttgaccaaataaaaacattccatggttcttcagtcaagatgccacgcatggacgttcaagtattctgacacgccattagcccaacaacattttaaaactgaggctgaccatatgctctgatcttgaataatttaaaaatcacatcattaaaatgagtggcactcagttttgcaataataagaatatagccaatatatggcccgacaaatgaccgaattccaaaattaaaatggtctgggcttatgggggcactgggggctttctgggcagaatggaagggatttttggagatgcacagccatttggcaatgataaatttgcaacaatgaaatattagagtcctactgagagagaatctcttctaccaccattcaaagaaaatcagctcgaaggtagaatttagtatgtggaattttgatcctgagatgaagaaagctggattcacattaatttaactctgagcaacttaatttcctgttttcttttccttgtgttaaaacatcatcctaaagtttccgtatgtggtaatgtttgtggaagcaaagtgttctgagtgtttctgaggctaatagaaaataaattagcctgaagaaaagtcttgtgttggcctttctgtgcaaatgcattcacataactaactctaagctagtgtgtataggagtcattccaagataacaagggaagaagctatttttaaaaacctgcacagagcagtcagcagacctatctgaccagtcctttggtcttttgccccttcttctgcaccaggaacatttttattgaagaacacctctctccagacacctccagccaggaatgctgctttataccttggattaataaacaatgctactgaagaagactcactgctttctcttctcatgaaaaaaaaaaaaagctatcagggaattaaaggaatgtggctgagtatcttccatacttttgcctccatcattgaataatcagtattatttgtgggaaatgcgtatcatgaggttgccagtgttttgcttctcagttgtatttccacaatctgaaaattaccagcaaaattcctgcccaccagtcgccacctacaggtcaaaagcaaccttcacacgggaccctgctttgcactattacacagtttttgagagtaacagtacttcccaaccttttaaaaatcccaaggtaaacttatttgaatacaagtcccacagaataggatattatccaatacctcgtgctgaaaatgtgatcaagggaagaaagactggagaagccacaattcacttgaactcttcacagtggaccaaaatgaagttatggcatcctaaccagggaatagtgccagagagaaaaaggtacaaagtcaaaagcgaatgaaattattttaaaattaagacaactgtatattaacaatattcagcatgaacagcatgtaagatttacaccattgtatataccatcatgatctgatttttgcacctgttttattagcaattccagatattgatatggtcaacacaattcctcatttttcatgcctatagagagtttctctcgaaattctgtacaattacaatgtgtcaataaaaattaaatgttgttaaaaaagaaattctatatagagaaaaattctatagaaactctatacttactatatatttagttggatattctccctggggatttgtgtcttcaattatttttgaaagagcataactctttccaaaagagtactgccactactctacactactattatgagaacaagtgctaccatggaaatctttgtgtaaatttatttatttatttatttatttatttatttatttatttatttattttgtgacagagtctcactctgtttcacaggctggagtgcaggggcatgatctcagctcactgcagcctctgcctcccgggttcaggtgattctcatgcctcagtctccagagtagctgggattacaggcacatgccaccacgctcgggtaatttttgtatttttttggtggagatgaggtttcgccatgttggccaggcttgtctcgaactcctgacttcaagtgattcgcccgccttggcctcccaaagtgctgggattacaggtgtgaaccaccgttccaggtcttatgtaaatattttttaaaagccaatttattaggccatcagcattattaacatacttgattcccctgcagtcctgatcacactggatcattatcatttttatttctgttacctttattagtataaaatgacaacttaaagcagctttaatttgcatttaattttatgtaggctgtagttccagccaacttttatattgatattcaactgcctattcaatgtctccagttgaatgtatcattggcatctcaacctaacaagtgcatcagagcccttaatttgcatctcctaaacctgtcctccacatcacacttgctcccctgattcccagtgattcccagctccctaagtagagccaccctgcacccaggcgcttaggctcaaaacctaggagttaatccttccaaaagtctttttgactccacctttaccacaaatcccaaattcatctccatcttcgctgctaccccccagtccaggccactgtgatctctcacctggattactgcaacagcctcctaactggtccttcttcttccatccttgcccctacagagtctactctacacaacagccaatgtcatatttttaaaaacctaaatcagatcatgtcactcctctgttcaaaaccctccagcagcatctcatcatgttttgaatgaaatccaaactacttaccttcaaaacatggcccccgcccacctctttcaactcagctttttacccttctccctattacccttgttctctccatctcaccccactggcctttttactgcccctcaaatgcatcaggttcactcctcaggcctttgctcttgtggttccctctacctgaagggttctccttcaagattttctcatggctggctccttcactttgctctcatttgacttgaatgtcacctcctcagagaagcctgccctaaacactctctgaaatagcactgctatcacccctgtgacttggtagcctatcataccattttattttcactgtaacacagaaaccatctgatcatcctgtgtcattgttaacattttatttttaatctgcatctgtctggttcaccattatatctttagagcctagaacagtacctaacatatagtaggaacttaataatgctaaatcttatgtaaaacagagactttgtg[211 bp omitted]gaggcaggagaattacttgaacccaggaggcagaggttgcagtgagccaagatcgcaccactgcactccagcatgggtgacagactgagactctgtctcaaaaaaaaaaaagtattacttccctacttaaaatactaataacagcacctaaagacccacagtgaaatgataatgcagacttgcttgttcttttggactcctagacctattaacattaatcagtgaacattgagattaatttaagtgtacctaccaagcacctttaagacagtttggggaccacagtgaagagtcaccctcaaacaactgagtctagaaagggaaagaaattgagacaattaactggaatctaaggaagaaaatggtgaatgtcaggagagacatttggtactttgggctacagacaagcaataatggttttaacattctttcacatgagtgttaaaattcctgagaataggctacagtcatgtttaagtgtgtcagtattgctcccttcaagagtgttgggacatgcataaaaatagttgtagctgtcacaataactagcatagggaggacaccactgccattttgtaagcaaggggccagcgatgctaactgccctgaagttcctaaacagacctgcacaacaaagaactccgcacctcaaatgccaacacagagtggcttatacctgcccatctaaaacgtatggaccactttctgggactccagattaatatttttaacatgctatcttttaggtagtcacttcggggttttttcccccccccgcaattttttttaaatctttttgacccagatcctatacacatcaactattcagcaaacagaaaacctgagtgcaagcaaaggatgaagaacagcaaggcccaccagaatgtctctttggggccctagcacagcgggctttcagccccaggcccaaagaaagctactatctatggataatgctccacaatgaggtacacagcattcctgtgtgttaagattattcacccttcacagagacagtttcactgcatgtctgacaatttcctaattacacaataagacaagaagctaatcctgagtgtgaaacttcccaagtgggggcttgtttcccttgagcagtggcccagggcctacaggattaggcaggtactaagcacgggggctggggactgggtaggaccatgggaaagcagagcacctgccccttgctaaagaagtcagttctgcacagctttgccctccacaagtgaaatgcagaccagaccttccagcatttcaagataagctggaaatcctgatccttactgagttcttttgctttttcaacattgaccactaattcaattgctttttcaaatcctgtgcaggccgcagcacactcatctaaggctgagtttgacccagggcccctagcgtgttccttctgcacactggacccaggaatgtatttggttgcacatgtctgctactctgtaggggttcaggaaatccaaaaacaatgtctaaatgtgctaccattgggtaaggttctcaagaatgagaaatgagaatgaggatgagagaggcacatgctggtcacaccaggtgactgatactgcctttgccatgctcttccttgccccaaaattctcaacatcccccacttcttactgcttcaggtaacagtttcccttcaaaggtctccaaaacatgatcctacccaccttgccagccctattttcaccacacccgtgtgtccatcccccattctagttgggccagtcttccttgagttcctttaaagatgttgatcccctcagccaaatatcccatctcctcatctaaagcctactcacccttcaaaaccttgctccatttcacctcttttatgcaaccttctctgtgacagtaaaaaccaaaatgcttttgagctccaggtctggtgtcaagcagatctgggttcaaatcccgcctctgccactgaccagcttggtgacatccttgggcatgctacctaacctctttgagcttcagaagatgataa[136 bp omitted]catggtgaaaccccatctctaccaacaacacaaaaattagcagggtgtagtggcgtgcacctttaatcccagctactcgggaggctgaggcaggagaatcatttgaacccaggagatggaggctgcagtaagccgagatcatgcactgcactccagcctgggtaacaagagtgaaactctgtctcaaaataaataaattaattaaaatgatccaagtaaagtacttaacttccagtaagtgttcagtaaattttcattattattatgactaccaaattttcactgaccttcctcttcttctgcaagtgctccagcccttgcgctgtctcttctgagcaaagggcaactagattccatgatgtccacatttgctctgtgccccaggcattagcctgcctcagcccacagcttggttttatagcttcttaaagtgccagaagcatgttggatacaacatagaacccacagacccaagtgtacactgaatcagagagttggacaactaccagcgccctggctctgaaataactcagcaaaagtctctctctctctagcaaaggtaggaatgcatgctgggaagataaactgcttcactgtttggaataagtctctctctcacacacgcatcaccaccaccaccaccaccaccaccaccaccaccattatcatctccatgttctctaacctctgtacctcgcctttcttactgtgggtagagatgacacataaagccagcaaaggccactctcttcacgtaagtgtatgatgggaacttggacaaacaggctgcactgcaggtatactctttggctggaacaaaatggaaagccactacaaaagccaaggtggactctgcaggccctgtccccctcctgcccaatgttactccacctcaagtcagccccatccatcctgatgtgtgtggcagctgggatcctccgggcacctttgccagcaggcctattccactagtcactttcctctgtgctccacaagggttgaaggaaaaatcccttcatggaagttactccatgcttcaagttactccattctttgaaggcctcccccagcctctctcccctccccccgcctctctcccctcctcccaaaaaaccagagcacagaaaaatgtaactgctggaatgtcacatgcttcaaaaggcaaacaaacaaaaaaccagaatttgagaggtcccaacatatttttccaaaaaatggttttcttagcatgaagaacgagccctaccgattgcactgcacaagtttacactctcaacagcatgaagttccaaggttagatcagacataggccggaaaacagggcgaaatgggcatgatctttgagatcatattctcaatctagaaaagacaccaagaagaggcccaaagggtaaccagtttcccatactggaacccagcgttccaatacacgtttgttacccctcggagttagcagcactagaaagttctgcctcctgtaatggtcgactttaaataaaaacacaaaaagcaggagaccaaaaggcggcacgggtcccaaggaccacgactatgatttcccctgagtgcgggtatggcatgcatatcctacagcatgggcctccccaacttgattcttcccctcgcctctcggcccaccaacccaagctcaggatcttgcatcccgaaagcgttgtgggtgagcaagccacagtcagattaaaacggtcttaatccaccccgccggaaacctcaagccgagactcagaatctcttgagaagtccctaaagccaaggacgagggtcatcagggggcggcagcggcagagccctgctaatgatgggcacttggcgtaccggtcgagcaggagagggcaccttcagttcccattagcgggatgtcactgccaacgtgcctcaggggaatgcctcgaccttcgcccaacagcggcctgggtgagccctcgagtgggttccggtgcgctccctggctcagcggggtctcgagtgaggggagagtggacctggaagagcctaggcgttactctggaaaacgtgactctgctggggcaagcggggaactcgggtctcttgcgcagcccctccccagtccctaccgaaggcccagcgtggctgcctcctctgaggacagagccgagggcatttaccgggagcttcaggaaccgttcgtctctactccaggatccggtaggataacgggactgccgccgccgtccctgccgctgccgccaacgtctatgccgccgtcgtcgcctccctctaaccgccgcagtcgcaaccgtcagcggtcccagtcaccccgtgcgactgtcgctcgcgaggccagctgttgaatggctcgcgtcgagctcaccgcgcgcagaagcgtcctcgctaagagggcaacgctggcgcgcgacccggtgccaacgccccgtgacctcctcgatcccctgaggctctggcgagctcaccgcggctgcctagtagctcgcgactgcgggttcgtctgcccgcgcgcgggctgccctcagagctctgccgccctggcggctcgccctgaacttgcaggcaagaccagtggcaatgatggactcttcccgccccctgattcccccagggccaatcgccttctcctgaggagcccttcaagtaaccccgcccctctcctgctgcaaaggccgagccaaagtttaccccaaggcgccgctactcccgaagatttcgaggctttgatcatgctactcccccgtcaacccctacgaagttacagtgatttagaggctgaaactcacttggcctactaacccccacgcgacctatttcctttgaaaaaacgagtatacaactaacgagagaggtgatgttgttcacctcatccctgaagtgggactgctgagaagtggccacgcgctcggccaaatttacacatcagggagtgaggaagaaccacaaaggccatcgactgactatcctcgcattgtttttttctgtttctggggcctgctttcggaggctggccaacttccagcgaccaggactcactggctccgtgtaccaccgttcgggtctccgacttcctggcttgagagtgagcgaaaccggtcccctggtaacttctgcacgtttgaggacatgcaaagtcagtcttgttcctcctgcccatggtggtccaacaatttgaacacaattccagccacgttcctccaggctctgttgctctaaagacctgggttcaaggctcgtctctgaatttaattcctttatatcttttgaaagtggaaggcaggaactgagtctatcctttacaccccaccccaccccagagtatagacccttcagcacagaggagaccaggatggccaagtcccttatatagacttctctggtggagctccctcaggtagcattcactttcttgacttccatatcacaaggcccattctatagaatatagttttaatatataattaaaactacagaatatagcttaatatagttataatattttgaatatttttatgcttcaaaataaaatcaaatataaccatattttgtatcatttaatctcttaagttatattccatccaatataaaacaaatctgtgtacactgatgcagtatacataatcatttcagttaaataaattgacctgaaaatttaatagctattccttattgtgttaggtaccatgaaaagggttttacatatacaaactgtataaaggtatttagtactaattaaaaaactgtgaccgaaattccattttttgtccccattttttaaatgaagaaaccgaggcatagaaagtttaagctacagccctacatgagcgattaaataacgagagctgagattctaatctgagcaatttagttctagatgctatgctgctgatcattacgttgatttgtattttaggttatccaatgctccaaatgggatatattaaagtaataacaatgggaaaattgcttctcttgtcatctaaagctttttgttgttgttgttgaatcttaatgattttgtgctttaattactttagtgaaatattttcttttctaatgcatagactattggggaaaagtaaaacagaattcagcttatcaataaatgatattcctgttagtgtatttccgggacttttgtttcaaacaatatacatgaagaatgcatgccattcatttcattttggggcataagcaacaacaattaaaaataaaaacaaaaatagaaataataccaagaaaactgacttgaaaacctattactaccaatgtctgggaaaaaaaatcatggttcaaaatctagttattcccacttattagctttataacacagcttgggcaagtgacttaattttctaggccactattttttcatttgcacaatgagaataattctttgcaatgtcgttttgaacattggtatttggaacacctaacccagagactggcacattgtgagcatttaataaatgtcagtgacataatgcttcaatctcatcttttaatgaaaaggctttcctggagtgagaccaaacccttgaatataccagttacaagaagagattatcagaaaaattagtctttttttaaagatttgcacaaaatatttagcaacagaactaccctgttatgctatcatttgatatatattttcaaaatataatgtcactctaagtgacataatcagtaaacatagcacagataaacctaaaaaaattcctaatcctagttgttactcttataataatcctttattacttaaattataattagaaaagccttaacaaaactaaaattcttaaaacatctacattttaatgtaagttaaatacatcataagtgtaagacaccattaaaatttagaaaaataaaacctaaagagcagtaagcaatatggcttagaattccctctagcattgcaaaataaaaataaaaggggcttaagcagtttcttttatttgatgtggctttctcttgaagaatataaatttgatagcagatacccaattatcttattaaggtccatatccatacacagggcagaaaattatcattaattttcaaccgaagtgacaacagaatccaaatattagaaagaaaacaaatttttaacttttgctgccataaatcctttataacccccaatcagtaatgcctgtttactatcaagttttaaggtgaataaaaaaaatccaagcagattattcaagtgttcaataatttgaaatgctgccattctattctagacctttggaaatcaacgtgagaaatgaatcaggttgcaagggattcacctactgtaagcttccttctgagtctggacaaaataagagttatgttatgtagcattggaaaagtgtcatgtagcattgatttactatgttactgatagcactgaaaaaaaaatcaacttaccttacccgagaaacagcaaaaagtgcagtctccaaatgttgtactttggttttttgttagtttgtttgtttgtttatttttgagacacagtatagcttagtcacccaggctggagtgtagtggtgcgatctcagctcactgcaacctccgcctcccaagttcaagcaattctcctgtctcagcctcctgagtagctgggattacaggccaccatgcccagctaatttctttctttcttttttttttttttttttttttttttagtagagacagggcttcaccatgttggccaggctggtctcaaactcctggtctcaagtggttcgcatgccttggcctcccaaagtgctggggttacaggcatgagacactgtgcctggcctgttgtcttttggataaaatcattagccgtgggtacaacctgaaagcacagagttgtattgaaaggcagccatgaagcccactcaattcatttgactctcttgcctgttaaaactatttgtggaaatttctgcccagcgtggtggctcactcccagcactttgggagaccgaagtgggcggatcacttgaggtcaggagttcgagaccagcctggccaccatggcgaaaccctgtctctaccaaaaaatacaaaaattagccaggcattgtggcacatgcttgtggtcccagctactcgggtggtctcagctactcaggaggctgaggcaggagaatcacttgaacccaggaggcagaggttgcagtgaactgagatcatgcccctgcctcactctggatgacagagtgagaatctatctcattaaaaaaaaaaaaaaaaggccaggcgcggtggttcacacctgtaataccagcactttgggaggccgaggtggatagatcacttgaggtcaggagttggacaccagcctggccaacatggtgaaactccgtctctactaaaaaacacaaaaattagtcaggcatggtggcacgcgcctgtaattccagctactcgggaggctgaggcaggagaatcacttgaacccaggaggtgggggttgcagtgaacccagatcgcgtgactgcactacagcctgagcgacagagcaagattccgtctcagaaaaaaacaaaagaaaagaaaagacttttgtggaaattttagtttactttaatatatttatgtcactgtggaatgtaactctgttacctttatatttaaaaattggttgaatcaatgaatatagcagaaactagtagaaaatgtattattttgaaacaaggcagctcatttatttgagctttcaattcttttggatatatacccacaagtgaaattgctggatcatatgatagctctgggggtttttgtgtgtgtgttttgttgttgttgttgttgtttgtttgcttgttggaaacctccatactgttttctatggcagttgtactatttttacattcccctaacagtacacaaaagttctaatttctccacatccctgccaatgcttattttctgtttatttttatagcagccattctaatcaacgtaaggtgatttgttccttatttttagcccaggtatatacccaattatcttacacagtgtttcatagtatgaaaaatccactatcaataaacaatttgtttgagcctgatcttcagttatttcaaacaatactgcagtgaacatccatgtatgaatatctttatatatatgttggataccttttgaaagataattgtgaggacaaaggatatgtatatttttgtagctttttattgtgatataatttcagacttacagagaagttgcaggaacacacgtatttccccaattgttaacagtttgtcggtttgttttatcatattttctctatatatgcatattaccttttttctgaaccatgtgggagtaaattttagctatgaggtccatttaactttaaatacttcagtatgtatttcttagaacaaaatatttctctttctgtcctagatgcatttatgaaaaaagaaaaaaatctcttttttttttttttttcctttgagacagagtttcactcttgttgcccaggctggagttcaagggcgcaatctcagctcaccacaacctctgcctcccaggttcaagtgattctcttgcctcaatctcccgagtagctgggattacagggatgtgccaccatgaccagctaattttgtatttttagtacagacggggtttctccatgttggtcaggctggtctcgaactcccgacctcaggtgatcctcccacctcggcctcccaaagtgttgggattataggcgtgagccactgtgtccggccgaaaaaatctccttacataagcacagtgcaaatattaacatcaggaagttaatatcataaagttctattatctaccctacaggccttactcataatactccaattgtgcagataatgttctttgtagcaaaaaaattggggggagggggtctgagatgtaattcagcatcatatattgcatttttcatttatatctagccttctttcatcttgaaactgttcttcagactgtctttgactttcatgattatggcattcttttcattatttttaaattactactactactattattatcattttaaaccaatcctaaacttatagaaaagttggaagtgtaatacaggttgttctggtttttttttcctgaaccctttgaaagtgatttgccaccccaatgtcccatttcccctgaataatttagtgtgtacctttttatatttttaatgacaaggatactttcctgtctaaccatgaatgaatcaaccatcaaaaatcaggaaattaacattaatagattactaacattgaatccccaggtactatttaagtttcatcagatgtctcaaaatggtctattacagcaaaaggatccagttcagaatcgtgcagtgcttttaattgtcatgtgtccttcatctccttcagtctggaagagttccttggtcttctgttgacttttaagactcaggcacttttggagactatgggccagttaatttgggaaatatccctcaatttgagtttacctgatgtttcccaatgattaaatttaggttacttatttttggcagggctatcacagaagtgacgctaggctctaattgcattctgtcaagtggagcataatttcaacgtgtcctattactactcatgatggtcattttgatctcttgactaaggtggtaagtgctaggcttctccactgtgaagttattctttgtaattagtacataccttctggggaagtacgttgaaactgtgtaaatattccattcctcatcaaactttcaatttattcatttatttgtttataccagtatagacttacggtttcctattttattcaatggattatagtccattattatcattgtttactttgatgctcaaattgtcctagatttggccactgggagcccctttaagctggtttccatgtccctttgacatgaccccatcatttttcgagcacctccttagtttctggcacaaaatattccaggctcatcttgtactttgccttctgtagtcccaaaatcagcctggagaagccctgattccttttagtggaaatggtatctagaagccaaatctgagcagcaggtgtatatattgttgttggtgtgttgctgctccctgagcctctcagagtcctcacttatatacacttacacacacacacacatttttatctatctatctatccatctgtcatttatctaaccatgagtttactctgatatatccaatccaacaccacagggttcattctaattttctttctttctgcattagtaataatttatgacaatgagaagatagcttacatcattcttaatatatttactcatttttatcaatactcctctatgtaactgtgccgggaggtttctaagatagccctcggtgatccctgcctcctggtattcaaccacttgtggaatcacctcccctggagtgtgagttggatttagtgaatcacttctaatgacagaatacagcaaaagttatgggatgttacttccgagattaggttataagatgactctggcttctagtctctctcttcctccctccccttgccctacccactcctccctttctctctctctctccccctcccatcctccctctcagtagctgagggaagctagatgcccttatggagagacccacatggcaaggagctgagagagccttctggccacagccattgagcaactgaggtcttcagtcaacgccccttgaagaaataaatcctaccaacaaccacatgagtgtgcttggaagcagagcctccctcagttgaagcttcagattttagctttgtgagagactctgagccagagacacccagctaagccatgcccagattcctgccacataaaaactgagataatagatgtgtattgtgttaagctgctgagttttgggggtaaattgtcacacagaaaaagatactaacacttggctgggtgcggtggctcatgcctgtaatcctaacactttgggaggccgaggcaggtggatcacttgagctcaggagtttgagaccagcctgggtaacatggtgaaaccctgtctctaccaaaaatacaataattagccgggcatggtggtgtgtgcctgtggtcccagctactcaggagggtgaggtgggaggatcgcttgagtctgggaggcagaagatgcactgagccgagatcatcataccactgcactccagcctgggtgacagagactccatctcagaaaaaaaatttaaaaaaaagcaaagaaataaatactgaaaaagtaatcaatctcccatgtccattgccacccctccctgacagctctgttctccctgcctgggtgcctctgattctccataaccagcctccctgcctcatggattccctctgcagcctgctcagactctggctccctacatcacctctcccccatgtgtatgacctcctcgttccactcaggctccaacagcccatgccatgccactccatcatgcggatgtccttgttagccctctgaggctctgacttcccacaccaggctgcccctccacagggatgccttcaccaacttgcttgactctgatccctcatagcagcctgtcttctacacacaaaccccttgccaaattgccctccaaaaatcttgtatcaatttacacttagtttatctctgtctgcctctccttttttttctttttcttttctttcttttttttttttttttttttgagaccgagtcttgctctgtctcccaggctggagtgcagtggcacaatctcagctcactacaacctccgcctcacgggttcaagcaattctcccgcctcagcctcccaagtaggtgggattacaggcatgcaccagcacgcctggctaattttcgtatttttagtagagacggggtttcaccatattggccaagctgctttcgaactcctgacctcaggtgatccgcccgcctcagcctcccaaagtgctgggattacaggcatgagccaccgtgcccggcctccctctccattttctttcttctctcacagggtgctggttggcttttccttcactgtttctaggtttcctcccaatgaaatgtcaaatggtccaattcttcttaaaaaaaaatcggcccggggcagtggctcacgcctataatctcagcacttcgggaggccgaggtgggtggattacctgaggtcaggagttcgagaccagcctggccaacgtggtgaaacctcatctctactaaaaatacaaaaaaaaaaaaaaaaaaaacccggctgtggtggcgggcacctgtaatcccagctcctcaggaggctgaggctggagaattacttgaagccgggaggcagaggttgcagtgagctgagattgcgccattgcactccagcctaggtgacaagagcaaaactccatctcaaataaataaataaataaataaataaataaataaacaaacaaacaaacagttgggtttatctgaactggcatatctaaatagggagcatttccaccttcaaaatgcaaatcttctctttcactctcactgacagttagggacttatatccttggtcagtgagttgtaatatagagaactataaagaggaaaaaaaggaagtatttataggaatatgctttccaacagcttgtgacaaggatgggcatttaaactgtagacatacaggaacttttccaaaaagggttcctttgctctttgttaagttccagatgcataaaaatctaactgagaaggggtcatttctttcttagcccattttttagctttcaggttacagtatgtggtcatacgtgtatttattctacctggagctcaagctagtctggctttatgtctctctgtcccttagggtaatatttatacttaacgtttataaggtactttatgtgactctcttaattcatccagtccatataatagcattaggagtttgctatttctgcccctgtttaacatatgagggaaaactgaacccctaaaagggggcgatttacccaaggtcacatagccagttagtaacaaaactggggctgaaactcaagtcttctgactccagccccaagaatctttttttttttggagacagaatctctctgtcatttaggctggagtacagtggcacgatctcagctcactgcaacccccacctcccaggttcaagagattctcctgcctcagcctccaagtagctgggattacaggtggtacctgccaccacgcccagttaatttttatatttttagtagagacagggt[135 bp omitted]tctctgggttcttctctttcaaagaagtattcttgaaagcttaagttccccttccaagttggagcctgaatatattgaaacccctgcccaagctgcctggtagactatatttagccaggccaaatcagctctttagaagtgaattgtgcttgaatttccctgcagctctttattgcatcatcaaaaatttttttaaagtcttggggatattaagattattactcttactgaaaaaattaacatagcaataaactgatatattaagcaaaaaaatccaacaccttcatcactatgttgagaactggttttgctgttaagtggttaggattaatttaagaagataaaacagatgccactgaaataaattaaatgtcctccaaagaagactggttaaataaatagcagtacaaggaaatactctataggtgtttgaaaagaatgaggcagatcaggccgggcgcagtggctcactcctgtaatcccagcaccttaggaagctgaggcaggcagatcacttgaggtcaggagtttgagaccagcctggccaacatggtgaaacctcatctctaccaaaaatataaaaaatttgccgggtgtggtggtgcacacctgtaatcccagctacttgggaggctgaggcaggagaattgcttgaacctgggaggcggaggttgcagtgagccgatattgtgccactgcactccagcctgggcgacagagagagactctgtctcaaaaaaaataaaagaatgatacagatcgatatgtgttgataaggagtgctctcctagctacattgttaagtaaatacaaatacaaataaaaaacagtgtgaacagtatcctgtcatttgtaaaatacattcatatatacacatatatatatacatgaatttgtatgtggatagaataatagaatttctccagaggaatacacacaaaaaatgaaatagtggatacttctgtagagagtaaatgggtgacaaaggtggggaagaaatatacttttcactgtctctttacatcatttttttcgtaccatttgcatttttgccaaaggcctgtattgcctattaaaaataattttagttgtatagtgctttacaattttaaaatattgtttaatatataattttattgaatatatatgcaatccaaagtagtaagtattatgcctttctcatagagatcttcaaactggttccaatctccaccctacttttcagctttccctctcttcactcgctgcatgctccagccacatcttagagaagattgatctccactttccctctctccttgccagcatggctccagctccactctcttactcgcttctaattaatgtaactaggcattgtgttctataattacagggcttgtcagtgaaatcaatagttacctcccatatgacaatgacattttagcttcatcaatctccttggagcccagtagcttctctgagccaacaaaacccccaagattattaacatatccctttgctctcactcatcttcatgcatgtgtataaatcagcagattctcaatccacaatttcatacaccctgccgatgattatttggtgataaaatgacaatcaaatttatattttaatggctttattgaggtgtaatttacataccacaaaatccactattgtacatgtacagttctatgatttttagtaaatataaagagttgtgcaacctcaaaggcatagtttttcatgataatcttaagaatctaacttaaaataacctagattataataggtttctgacatactcagtttctttcctctgacttcaactctcaagtgtgttccctgccttacttttcaatggaagacacctaattatattgtttccttaaaattacagcatgtgagacttggaagggcccttagaaatcaactacagataggaaacttagatccagataggacatatgatttgcccagagacatataacaggttaatggcagagtcagaactaaaacccaggaatttttttttttgtcgcccaggatggagtgcagtggtacaatctctgctcactgcaacctctgcctcctgggttcaagcgattctcctgcctcagcctccagagtagctgggattataggcgcgcaccaccacactcggctaatttttgtatttttagtagagatggggtttcaccatgttggccaggctcatctcaaactcctgaccccaagcgatctgcctgccccagcctcccaaaatgccaggatgacaggcgtgagccaccaagaccggccaaacccaggattcttattacaaacccaatcaactccctatgacaacaccgagcctcttctctcaagcattgctaatgtcctggaaatcagtgaatcaaccatcattaatcaatttgcctggctaaatctgaagatttgatgatgggaaaagggcttggcttgagggtgggtctagagaacaggtaggagatataaactcttttcctttacattccttctggatgaatttctttcttagtatttaggacaactaacggagaagataggttcctttctgtctaaagaaggatcttatgattatctgtcaatagtacctatcattattattactcttattattattgtattttctccagcgtatgttagcaagatgtgaaggtggtatgaaactgtagccaagaaaccacataggcaccgcttcctgcttttgcctaaaactgtgctaaaattagcccctaatccccacggatttgagccagggaaagcaatgtagcttctcatcttgtttttctagcaatcagtaagttgctagacagttgtaagttaaacaactgatgataaagagagaaataaattgtatatatttgtgtgatgagaactaaaaatgctctctgtcaccaactatagtgttacttggtgtcaccatagtaggagggaccaggccaacaattttgagatgctgaatatggcattctgaacttaacgagaaaactccaaaatactcagattgacatggaatcaccatcaactacttttaaattttttattagaaccttacctcccttttgagtacaacaccagaaaaaaaagaaagaaagaaagaaatcatatctcccccttaaaaaccatcttcccccacccccagtaattcctattctaagaatatatcctaagaaaaagcagagattcatgtacaaagaaattcatcactgttttttcctttttttttttttttttagagacaaagtcccactctgtcgcccaggctgtggtgcagtggagtgatcgctgtgatctcaaactcctgggctcagatcctcctgcctcagcctcctgagtagctggaactacaggcacacgtcaccatgcctagccagttaaaaaaaaattgggggtagcaacagggtcttgctatgttacccacactggtctcaaactccaagccttaagtaatcctcccacctcagcctcccaaagtgttgggattacaggcatgagccaccacacctggcccccatcacaatttttataagagtaaaacattggaaataatttaaaacaattgagggtgcttaaatgaaatacaataactccataaaagggaattgtatgcagccatgaaaaatcaccatctcaaaaaaatcttttcaaaaatttttatcatttgtaacagttttctgagataataatttgtataccataaaattcactaatttaaagtgtaaaattcactaatttaaagtgtaaaattcaaaggttttcagtacatttacagagttattaaactatcaccacaatctaatttcagaacatttttatcgccccaaaagagtgttcgtaccccttagcagtcactcctcacactctcaacctataaattgataagaaaaatgcaaatgatccaaaagaagattggacaaaggaaagtaagtcacagaaggagacatgcaaatgaatataaatattaaaatatatttatatttacaagtgataaaggaaatggaaataaacacagtgagataccatttttccatttactattttcatcagcaaaaatgagaaacactggtaacatccgctactggtaagcatcagggaaacagg[133 bp omitted]aaaccccatctctaccaacaatacaaaaattagccaggcatggtggcacacgcccataatcccagctacttggaaggctgaggcaggagaatctcttgaacctgggaggcagaggttgcagtgagctgagatcgcacaactgcactccagcctgggcaacagagtaagaccctgctacacacacaaaaaaagactatgaattgttaaaacctttttggaaaataatccagcaccatttaacttttttaaagcacataccattggggccaggaaccccacttcgggaatttatcctatagaaattaaaataccagaatgtaaagatagatgtacaaaaccataggaatagcgagttacagagccatgtgtgtagtatgatagcatctttatgccagtaactgttcttcacataaaaaatgcatgcctgctttcagtcctcccagaaaccctatgactgcagacaatattcttactctccagaggggaaactggggctcagagaaatgaagcaatgtactttaggtcttacacagttaccaaatggcagagctagcattccaatccaggtccatctggtcccccaaaccaagatatctgccaaggatgataactttctggttagagtacctgaaactccctcagtagaggtgggactaatctttcaggatgtcatttttaagagtgcaaagtgaattcacgtctcaatgaaagggatagaagtttgtaatgctggaatttggtgagagaatagttagtagtggaaaagggttgtggggaacatgaaaaactcaataattaaaattcatttattcatttatctaacaaatatttattagcatttactatgtaacaggtactgtttaaagcattgaaggatttatcaatgaataaaacagaaaaatcccttcccttggaaatttacatggggggagggggctgaagcagacaataaacaaattacatatgaaaataacatatgagatggcgaatagtgttataaagggatatcctttcaagttcacatagttgttaacggaatttgcttccttgcagctgtagaattcatgaaaatttgcttctttcaggctaacaagagagagtagatctgtgatctctagacttcgttttaaagagctcacctgattaggtcaggcttgccctgggtaattttccatttgattaactcaaagttaacttctaactaaggaccttaattacatctacaaaaatttctttacctttaccacataacaatctaatcaccagagtgacatccgtcatattcacaggtttcaccctcactcaaaggaaggggattattcatggtatgtacaccagggggcaggaatcacgggagcagatgtcaattgggcagttggatatatgagtctggagctcagggctgaggtctgaattggagatgtacgttatgatgtcatcaacacatagatggtatttaaagctatgagattgtatgagatttaaagcctccaaaaaaagtaatattgatagataagagatctgaggtatgagccctggagaacacgaatgtttagaggttgggaagatgaaaaggaaacaacagtggagacagacaagaaggagctagtgaggtaggaggcaaaccaggagagtatcttgtcctggaagccaggtgaagaaggtgtttcaaggaggagggagtgatcaactatgtcaagtgctcctgcttggtcatgtaagatgatgacaggatagtccattgaatttagtaacatgacagtggtcctgacaaaagcagcttacgtggagtggttggggtgatagcctcatttgaatttgttcaagagagaaagaggagagagaaattggagttggcaagtgtagacaattctttcaaagaacttggctgtagacaggagtggagaaatgggtgcattagctagaacagaaagtggggtcaaggccgggtgtggtggctcacacctgtaatcccagtattttgggaggccgaggtgggcagatcacctgaggtcgggagttgaagaccagcctgaccaacatggagaaaccccgtctctactaaaaatacaaaattagttgggcatggtggtgcacgcctgtaatcccagctacttgggaggctgaggcaggagaatcgcttgaacccgggaggtggaggttgtggtgagccgagatcgtgccactgcactccagcctgggcaacaagagcaaaactccatctcaaaaaaaaaaaaaagtggggtcaagagaattttttattatggaagaaaaacatgcctatatgccgatgggaattgcccaataagaaggaaagttcgattatgtgtatggaggagagggcttgctggaacaatgaccttgaagtagtaagaaagaatgagatccagagtacaggtggaagggttgtacagataggtcatctacagaaatgtgatggaaggcagaatataggcaaaaatgcaggcagatgggtagatgtgttttgagggtctgtggcaattgtcctctgatactctgatttttagggcaaaccgaaagtgtctcctgcattctcccacactgcctggagtgtcagcatgagattactttcaggtgttcccgcaaaacaggcacattttatgtaccacttgtaccacttaagaggggattttagtagctttgtgtttaacatttattagaagaaggtaactagtacacctaatgcatgatttttcagatataattgcaattttaaaatgtaaacaaaagaaaagtgttagctaaagtacagaagaggttgaagggatatagcaaaacttttagtcagttgtgaataactgacccttgagagaatgtcttaaggtactggatctgctggagtccctctttaagagcagacatctctgagataacacatttagtcagcttcattcctgaaattctactgtgaatgaaactgagacatatcaggactgaaaggaatcccccagggtctgctagtttacattcaaggataaagaactctataccactgaagactgagacagtttctttcatcctgaggggcctctgactaaaagcaaaacaaaaatacaacaaattgaaaaggcaaaatttcttatataaccacacagtgaatataaacagaaagcctagagccatgcattatgggagatgccacagggaaaggagtctgtagatgattgagaaaaagggtttctccaggtagagagataggaaattgtggtagacagaataatgaatcctcgaagatgtctatgtcttaaacccctggaagctgtgaatatgttaccttacatggcaaaaaggactttgcagatgggattagttaaggatcctgagatgggaagattatcccggattatccagatgggcccagtgtaatcacaggggtccctgtaagagggaggcaggaggatcaaagtcagggaagatgtgatgacagaagcaaaggttgcagtgatgtgctctgtagatggagaatacagtcacaagcaagaaattcagacggcctctggaaatggcaagaaaacaaattctcccttagggcttctagaaggaacacagtcctgctgtgatatggtttggctctgtgtctctactcaaatctcatgttgaattgtaatccccagtgttgggggagggacctggtgggaggtgattggatcatgggggtggattccccccctgctgttctcatggtagtgagttctcacgagatctggttgtttaaaactgtgtagcacctcccccttcactctctctcctgtcaccatgtgaaggtgtgcttgcttccccttcatattttgccatgattataagtttcctgaggcctacccagccatggctcctgtatagcctgcagaactgtgagtcaattaaatctcttttctttataaagtctcaggtagtttttttatagcaatgtgagaatggactaatacatactgacagcttgattgtaaaacttttggcctctagaactgtcagatagtaagtctgcattattttaagccactaaatttgtgttagtttattagagtggcaataggaaattaatacagacatgatggaaacttagaatgccaggtttgaaaaggctttctggcaaagcctcctgtctggcctgttgattcctggaagatgggagtgaaacagatccgaattcatagcatattttctttattgttcttgtggctcttggcatatgtttctctgtattaatattagttatcttcccattagatgtacgctacttgtgggcagattcagttagcatatagcacaggaccttgcccatctaacaggcaagcagcaatgatgctttgcaattgcataattttagctggagtttctaaaaggctttcacatatgaccctacaggcatcaacataaactgaaaatagaagggcaggaattatagaaggtgtcacagattggagagaggaagttcccagaagagactgtaaaagagacacttggagtgagaaagagaggaaaggggacaaatgccaaggaaaggaaatgagttttccttacccaggaaaaattggcgaaggctcacaacctttgactcttatcttgaaagcaagccaggaggcctatgcaggagtgagagaagccacaaatcactacatggcccgtggaagtagagcaggttggatcccagctgagggtcccatccagcatcctgacccccactcctatcctagccagtctgactggcaggaatgcaaaagggatgtttcctgcctgcctcaagagtttggtaactcttccattaggtagctggttagatctggaggagaaagctacataacccacttggggtttcagagggagccaaagtcaacttcttcagcacaatgccaggcaagctagacagatggcagcagaggagctatcagctcctgaatttcaaagaccagccaaggggagagacagagcttggccaccatggaaatagagaagcccaagaagataggggacccataattttcaggcctagtaattctcaatgtccatgtatagtccactcatgtgacttaatgtcttatgggcagtatttttcagtcaattatgccttgtaaaacaactctgggaagaggaactattctgtgaaattgctgggtcatatagtagttgcatgtttagttttttaagaaaccatagtcaggtgcagtggctcatgcctgtaatcccagcacttcgggagaccgaggcaggtggatcacttgaggacaggagttcgaaaccagcctgggcaatatggcaaaaccccatctctacaaaaaatacaaaacattagccagcatggtggcccatgcctgtggtcccagctacttgggaggctgaggtgggagaatcgattgagcccaggagtttgaggccgcagtgagccatgatcacaccacttcactccagcctgggtgacagagggagaccccaaaagaaagaaagaaggaaagaaagaaagaaagaaagaaagaaagaaagaaagaaagaaagaaagaaagaggaaagaaagaaactgccatactcccttccagtatgattgtatcattttacattccaaacaacaatgtacataagtgattccatctctccacacccttactagcatttgatgttgtctctaatattatttattctgacaaatacatagtgatacttcaatgtggttttaatttgcatttcccttacaatgaacatcattaactatgcttatttgctatctatatctcctcattcatggaatgactcttcatgacttttgttcattttctgattgaattgattggttttattttttaactgttaagtttttgggagttctttaaatattctgtatacaggtcctttgttggatatgtggtttgcaaatattttctccaagcttatagcttgccttttcatcctctttcgcaaagcagaagtttttcattttgattaagtccaatttataaatttttccttttatggctaatgcctttggtgtcaggtatgagaactattcacatagccctagatcccaaagattttctcctgtgtttttttttctaaaacctttatagttttgtgttttacacttaagttcataatccattttgagttgatttttgtgtaagatgtgatatataggtcaaggtgtttgtttgtttgtttgtttgttttttgcctgtggatatccaattgttttagcatcatttgttgaaaaagctatatttcctccattgacattcttttgtgcatttgtcaaaaatcagtttgccatatttgtttttaagagtctgtcctggattctctcttctgtccctccaatctgtgtttatccctccaccaataccacactatcttgactaccgtagcatcatattaagtcataacacaagtgattccatatactttaatcttattaacttattttcactacgttttaactattctagggcctgttgctttacatataaattttaaaataaacatgtctttgtctacaaaagttcttgctatgattctaataattattgcattaaacttgtatatcaatttggggagaattgatgtctttactgtgttcagttttccatccatggtatgtctctccatttatatagatctttgatttccttcatcagaattttgtagtcttcagcatacaagtgctttacatgttttgttagatttgcactgaagtattaaattttttagctattgtaaaagtattctatttttcatttcagtgtccacacattcattgttgatctagtatctgacagccttgctgaatgcatttattagttctaggtttttaaatgattcctgagatttactgtgtagacagttatgtcatttgcaaatagaggcagttttatttatgcctttctattttgtatgccttttatttccttttctcatcttattgcactgactaaaacttccagcactttgttgaataagagtggcagctgggcgtggtggctcatgcctgtaatcccaacactttgggaggccaaggcatgaggatcacttgaggccagaagttggagaccatcctgggcaacatagtgagaccttgtcttaaaaataaaataaaataaaagagtggcaagagagggcattcttgtcgtcagctataggtttttgtacttgccttttatcaagttgaggaatttccctctattcctagaaaactgagtatttttttattctgaatgggtgttgtattttctcaagtcacttttctgcatcaatttatgtgatcatgtaagttttcttcagtggccttttagtatcacagattacattgattgatttttgaatattgaactagctttgcatctctgaaataagcactattttgtcattatgcataataccttttatacattctgaattctatttgctaatatctttttttaaaaaatttatttttaattttgtggttatataataggtttatatatttatggggtacatgagatattgtgatacaggcatgccatgtgtaataatcacaccagggtaaaaggagcatccatcccctcaagcatttatcctttctttgtcttacaaacaacccaattattctcttttagttattttaaaatatacaattattgttgactgtagtcaccctattgtgctctcaaatactagatctcattcattctatctaattatctttttgtacccattaaccatcccctcttcccctccaacattacccttcccagcctctggtgatcatccttctactctctatctccatgagttcaattggtttaatttttagctcccacacataagtgagaacatgtgaggtttgtctctgtgtacctggcttattgcacttaacataatgtcctccagttccatccatgttgttgcaaatgacaggatctcatcctttcttatgactgaatattactccattgtgtataagcaccacattttctgtatccattcatctactgatggatacctaggttgtttccaaatcttggcttattgtgaatagtgctgcaataaacatgagagtgcagatatctctttgatatactgatttcctttcttctgggtatatacctagtagtgggactgttgaatcacatagaagttctatttttagttttttgaggaacctccatagtgattgtgctaattcacattcccaccaacagtgtacaatggttcccttttctccacatcattgccaatatttgttattgcctgtcttttgaataaaagccattttaactggaatggtatatcatctcaccccagttttgatttgcatttctctgatgatcagtgatgttcagcactgtttcatgtacctgcttgccatttgtatgtcttcttttgatgtttattcagatcttttgcccgttttaaaatcagattattagatttttttttcctatagagttgtttgagccccttgtatattctggttattaatcccttttagataaatagtttgcaaatatattctcattctgtgggttatttcttcactttgttgtttcctttgccaggcagaagcttttaacttggtgtgatcccatttgtccatttttgctttggttgcctgtgcttgcggggtattactcaagaaatctttgcctagtccaatgtcctggagagtttccccgatgttttcttgtagtagtttcatagtttgaggtcttatatttaagcctttaatcccttttgttttttcatatggtgagagataggactctagtttcattcttctgcatatggatatccagtgttctcagcacaatttattgaagagactgccctttccctagcgtacgttcttggcaactttgtaaaaaatgagttcagtgtagatgtgtggatttgtttctgggttaaacaaattttcaagagaaaaacaacctcattgaaaagtgggcaaaggacatgaacagatgctttacagaagaagacatacatgcggccaacaagaatatgaaaaaaatctcaatatcactgatcattagagaaatgcaaatcaaaatcacaatgagataccatctcatgccagtcaaaatggctattactaaaaagtcaaaaaataacaggtgctggcaaggttgtggagaaaagggaacactcatacatttgttggtgggagtgtaaactagttcaaccattgtgaaaagtatcctggagatttctcaaagaactaaaacagaactaccatttgatccagcaatcacattactggtatatacccagaggaatacaaatcattctaccataaagacacatgcacacaaatgttcattgcagcactattcacaatagcaaagacatggaatcaacctaaaggcccatcattggcagactggattaagaaaatgtggtacatatacaccgtggaatactatgcagccataaaaaaagaacagtatcatgtcttttgtgggaacatggatggagctggaagctattattcttagcgaactaacgtaggaacagaaaaccaaatactacatgttcccacttattagtgggagctaaatgatgagaactcatgaaaacaaagaagggaacaacagacactgggtgctccttgagagtggaggttgggaggatggagaggaacagaagagataactattgggtactggatttaatacctgtgtgattaaataatctctacaacaaacccccatgacacaagtttacctatgtaaaaaaccttcacatgtacccctaaacctaaaataaaagttaaaaacagaatatatcattattaactatagtcatcacatcgtgcaatagatctcttgaatttattcctcttatctaactgaaattttgtatcctttgaccaacatcttcctcaaccccttcactgcccccagtccctggtaaccaccattttattctctacttctatgtgttcaaatgtttaagattccacatataagtgagatcacatggtctttgtctttctgtgcctggcttatttcacttaacatgttttccagttttacccatgttgtcacaaatgacacgatttccttcctttttaaggcggaatagtatttcgttgtgtacgtataccacattttctttatccattcatctgttgttgaactcttagattatttccatatcttggctattgtaaataatgctgcaatgaacataggagtgcagatatctcttcaatacactaattgtattttctttgggtatatacccagtagtgggatggctagatcatatggtaaaaattttacttttaattcttcgaaaaatctccatactgttttcaataatagctgtactaatttacattcccattaacaatgtacacgggttccctttctccacatcctcacaaacacttgttttttgttttttgttttgtctttttgataatagccattctaacaggtgtgaggtaatagcacattgtggttttaatttgcatttctctgacaattagtgatgcttagcatttttcatatacctgttcatcatttgcatgttttcttttgagaaacatctattgaggtcctttgcccaggttttttgtattcctgtatttttgtattctttaatcaggttatttgtattcttgctgctgagttattttagtttctcatatattttggctattaaccccttataggacatacgctttgcaaatgttttctctcattacatacattatcttttcactctgtttattgtttcctttgctgtacaggagcttttcggtttgatgtaatcccatttgcctatcttcacttttattgcctatgtttttcaggtcatatgcaaaaataattgcctagaccaatgtcatggttatttcccctgttttcttctagtagtttcatagtatcagttcttacatttaacactttactccattctgagttgattttgtatatagcgtgagacaaggatctaatttcattcttttgtacataaataattgttcaaacaccaattattaaagagactctcctttcctgctttccccattatgcttttccccatttcccccattgtatgttcttagcacctttgtcaaaatcaattgaccataaatgggtggatttatttcagggctccgtattctgttctattggtctatgtgtctgtttctatgccagtatcacgctgttttgattactatcgctatatagtagattttgaagtgaggtagtgtgatgcctccaggtttgttctttttcaagattgttttggcagtttggggtcttgtggtttcatacaaattttaggattgctttttctattttagtgaaaaatgtctgaaattttgatagacatttcactgaatcaatagattgctttgggtagtatagatattttaacaatattaattttccaacctgtgaacatggaatatctttccatttatttgtgtctttttccatttcttttattaaaattttatagtttttggtatacaggtttttcacgtccttagttagatttattcctaagtattttttgtagctattgtaaatggaattattttcttgatttctttattggatagtttgctgttagtatatagaaatactaccgaatttttgtatgttgattttgcatcctacaactttgctgaacttatttgttctaacaggattttttggcagaatctttagggttttctacacataagatcatgtcatctacaaacagggacaatttcatttaacttcttcctttctaatttggatgtctttctttctcttgcctaattgctctaactagggtgtccagtgctatgctgaatagaagtgataaaagtagtcattcttgtcttgtttctaatcttagtggaagagcttttaacttgccactattgagtatgatgttacctgtgggtttgtcattcatggcttttattatgttgaagtacatttcttctatatctaattttccagagtttttttaatcatgaaaggatgttttcaagcaattttgttaaatgcttttctgaatctattgagatatcatatggtttttgcgcttcattctgttaatgtagtgtaccacatttataggtttgtgtatgttgaactatccttgcatccctggaataaatcccactgatcatggtaatgatcgatttctcatcgagccttagctaccttcccgcggggcagggctcgggacctgcagcccgccatgcctgagcctcccacccactccatgggctcctgtgcggcccgagcctccccaacgagcaccgccccctgctgcagggcgcccagtcccattgaccacccaagggctgaggagtgcgagcacacggcgtgggactggcaggccgctccacctgcagccctggtgcgggatccactaggtgaagccagctgggctcctgagtctggtggggatgtggagagtctttatatctagctcagggattgtaaatacaccaatcagcaccctgtgtttagctcaaggtttgtgagtgcaccaatcaacactctgtatgtagctgctctggtggggccttggagaacctttatgtctagctcagggattgtaaatacaccaatgggcactctgtatctagctcaaggtttgtaaacacaccaatcagcaccctgtgtttagctcaaggtttgtgaatgcaccaatcgacactctgtatctagctgctctggtggggccttggagaacctgtgtgtcgaaactctgtatctaactaatctgatggggacgtggagaacctttgtatctagctcagggattgtaaacgcaccaatcagcgccctgacaaaacaggccactgggctctaccaatcagcaggatgtgggtggggccagataagagaataaaagcaggctgccctagccagcattggcaacccgctccggtcctcttccacactgtggaagctttgttcttttgctctttgcaataaatcttgctactgctcactttttgggtccacgttgcttttatgagctataacagtcacctcgaagatctgcagcagcttcactcctgagcccagcgagatcacgagcccaccgggagtaaggaacgactccagatgctctgccttaagagctgtaacactcactgtgaaggtctgcagcttcactcctgagcccagcgatatcacgagcccaccgggaggaatgaacaactccagacgctctgccttaagagctgtaacactcactgcaaaggtctgcagcttcactcctgagccagtgagaccacgaacccaccaaaaggaagaaactccgaacacatctgaacatcagaagggacagactccagacgcgccaccttaagagctgtaacactcacggccagggtccgcggcttcattcttgaagtcagtgagaccaagaacccaccaattccggacacagtagtgaaagtccaggttacacccttggcctcctttcatacctgaagggggctgttgagtgggggtaggagttccagctccccactcagggtccactgatacctggccgagaggtacaggaaggcttcttaatggtctccatgtgggttctactgacataagtggaggaggctcttttactcccaggaagtggctaaagtcctgactctcttccaagcctcctctgacagcaccaggcaggagggttaggaggccttcttatataaccttgtgtgggtggaagtctaggcttcccactaggcctttgctggcatggataagggtgttgctgcaatggtctattgggctagagaaaacattttccttggggcctttttttatctctactcattggcagttctgaattgccagcctctgcagttctgggtcgctgccttctttagcccaagtctaggatatatgaggcaaaaaaaataaaaataaccacccaagaaactcaccaccatatcatttcttgggtcccaagatccttaggcggtctgccttctcttcacctttcagagccttcttatgtttgttttatatacaatgacgagtttttagttatacttagtgaaaaaatagcaaaagttatgtgtactccactttcccaaaagcagaagtccgagactttaaaaaataattaattcaaaggatagagatcaaaggtaaaaatattttcacactcttagtctcattcaaatcaagaaaatgggtagcctcaaggtgtggggctctgtctctaaggaaatattacccttggctttactatcctttaagcaatagggaaactatgcacttttaaaagagccccttgtgttttgagctgcttgtgttcattcttattcatcaagtatttttttttttcaaagtgagctccgcagagtaccttcctcagcattatcttgaaataatttaagacatagaataccatgtcctgatctagacctgctgaattagagcccaggattggagattaggaacctatattttaacaatcatctcctgcccccaaggtatgagaacctctgatttaagccattgataaaatttctgaaggagatcaggccaataataaagacttgtaacaggcctggagactgtccttgagaagctattaatcatttatcaggacccttggggcagacttggtcaaccagctactaaacccccttattattctcacagcgagtccttattgtgctgctttgcaaatatcatgaaaatcctcaggtagtgctttgccaaatttcacttgttttatctgctgcattgccctga[137 bp omitted]agtgaaactctgtctctactaaaaatacaaaaaattagccaggtgtggtggcaggtgcctgtagtcccagctactcaggaggctgaggcaggagaatggcttgaacccaggaggcggaggttgcagtgagccgagatcgagccattgcactccaacctgggtgacagagcgagactccatctcaaaaaaaaaaaaaattaaaaaataataaaaaataataatgaaactagtctgacaggtttcattcccagtgaaattacactgggtccagtgaacataaaccatccttttaaaataatccactttagattgtctcctggaatcaacaacaagcttgttctgtccatttacacttcctctattatttcctttttgaaatccatgatcacatttgcctgtctttaggcttctacgacccccctgcatatgctccaaattgatgaaaataaaattatccccaagggtggtttagaggtctcatttgctagttcttccaatattctgagagatataatttgtccagacaactgaacttggttaaagcaatgaaatactctttgacaaccattttacataccctggacttttcttcttttatcaatatttggtctaaactcttgttattcaaagtatggttcgaggaccaacagtagcattacctgggagcctgttagaagtgcaaattattgggccccacccagacctaccaaaccacaatctcattttaacaaaattcctaagtgatgtataagtgtgttaaagtttgaaaagcattgggctagactgttcagtatgtaaatttctccttgacaaaaaatataggtgcaaagtgagaacagaggagttctgctctatctttatcatccatcagtatgtcaatatcaattggacccctttctcaattgtcttctggctcttaacacaactttgtaataattatttatgtaactttgtaaaaattctttatgttgctcttatcatttcttgaaagcctcaggtctacatctggtgtttagccttctggacactgtttatgtaggtctacaccagtctcctgcatttattattggttttgtgggggtcctttccaaatttaacctgctaagaactaaaagtttctttttctcttttctttttttttttttttttttgagacagagttgcccaggctggagtgcaacagtgtgatcttggcccactgcaacttccacctcccgggttcaagcgattctcctgcctcagcctcctgagtagctgggattacgggcatgagccaccacgcccgactaattttgtatttttagtaga[143 bp omitted]tttctcctatgctgttccagtttcaacttctccatgtcttctacctgcaaggttacctgtagaaatctaactgcttcgtgtccgtcatgaaatgccaatgtacatgctaacagtgctttctatcacttctcccaaagctttcaatctttgagatccccaaatggttttggattagaagggtgtcctccccagctctgtgccatactctgtcactgaggctttgaaacaactcagcttttgctcagtctcttaaaatctcccttaggcagggccagcaatttattatgttcattcatttaatcatggaagttaaaggtccggaaagggaattgatgccatattatccccttggagctcttcttatcctcttctagcccttctcatcaccaaaagctcttgtcttatctcatggttacaaagcaaatgaccccacatatataagtgaatgcaaatagacactgatgtgtgtttaggaaacaggaggaaagaagagactgtatactttagtagtgactggattccagttcagtccatcaaatgtgcacagttatcactgcatttgattaatttttaaacatttagggaatttcccagatatctttcttttttgttgtggttttttttgtttcacttttgtttttcccagatatctttctaagtattaatttctactttaattcctttatggttagtaagcatatcttttattatttttatcattttatattttttgatacttcctttacagcccagcatatggtttctcatggtgagtgtttttcatgcacttgaaaagaatgtcttctgttgttttgggagagtggggaggagtgaactataaatgtcaattaggacaagttgattgatggtgtcttaatgactgttaacttgttcaactgattactgagcaaggagtgttaaagtctccaaatataattgtgaatttgtctatttctcctttaaattataccagactttgcttcaaaagttttgcagctctgttaccaggtacacacacttagaattttgtcttcttacgaatgaaccattttatcagtatgaaatatccctctgtatctctggtagtcctcatgtcttaaagtctactttatctcatgataatattgtcagtagatttcttatgattagtatgtgcatagtatatttttccttctttttactttaacctgtctttatatttacagtaggtttcttatcggcagcctgaacaacttatgccttcatttggggtgtttcctatgtttaatgtaatcattgatatggctgtttctaagtcttccatcttggtattttttttccatttgtcccatattttccttgttctttttttcctcctcttctcccttccttgacattacttgaatatttttagtagtctattttggctttttagccatatttcttatttgatttttttatttttagtagtagtattttatgaattaaagggttaattcatacgaagacagaattcttaaagtgtatgtacctgataacaaagctgcaaaacatttgaagcaaaaactggtagcatttaaaggaggaatagacaaatccacaattatatttggagacagtaacgctcctttctcagtaatcaatacaagttgatagtcattaagacaccatcaatcaacttgtcctaatctggggattacaatatgcatccataacttactacagcgtacttttttttttttgagatagggtctctgtctgtcacgcaggctggagtgtagcagcgctatctcagctcactgcaacctctgcctcctaggctcaagcaattctcccatctcagcctcccaagtagctgggacttcaggtttgaaccaccatgccagactaatttttgcattattggtaaatgcgaggttttgccatgttccccaggctggtctctaactcctggctcaagcactccacgcatctcggcctcccaaagttctgagattacaggcatgagccactgcacttggccaataacttattacagtgtactttgaattaatattgtaccaattcacacatataatgtaaaaaccttataacagtatatttccttttactcctcccttttccagtgtactatagtttttatgcatatttacttctatatagtttatagatcccataatacattgttagtctttttgctttacatagtccattgtcttttctagtacattaagaaattcaaaaaacaagtttttaaatatttactcaagtgtttaccattttcatttctacatgtagctttgaatttccagctggcataatttccctcaagcctgcagaatttcctttaacgtttctcatagagcaagtcagcttgggatgaattataattgattctcattatttggggatctataaagtcatcacacacactgagttaagaaatactgaaccactgatcctaggggaaatacagtaggttcatacaagcctctggtcacaacagtttcatcaactgatcaatatgtagccgtgtgttatatgtgtttctgtttgaagatatcttctatattagatactgttgattcattgacatttaactcatggccaatggtattttaatttatgcttgaacaaaacttaaataacacatttttttttccattaggcatatcacagccttgttgcacttaggaatgctaaacatcacttcagtactacattttgggaccgtttaagatagtgaaattactaataaaaatgtggaaaatgtgacactaaatagaccatggaaatgacacttttttacagtatgagaactgaagcaagaaggcagaacattgcattgtttggcctcagctgggaacatgcactttaggcaattcaaattttttgctgctctccatgtgtccctgaaagctggtgaaagtaccatgagaattgatttggggttacaaataaattgtagcaagtaggtgaatttgcaaataaataatttgaataataacaattgactatatcttatctttctggaatgttttgtcttcctttaaagagtgttgagctttggggggacattgaatttttttctggcaggctattacttatctaatgtctaaaaatatttgttctatatattttatttatatttatttacagcaagaaggtaaatctgatgctcatttctccatcatggttaaatcatccctgcatttggagggtgtgatggttaatactgagcgtcaacttgattggattgaagcatgcaaaatattgttcctgagtgtgtctgtgagggtgttgccaaaggagatgaatatttgagtcagtgaacagggagaggcagacccactcttaatctgggtgggcgccttctaatcagctgccagcatggctagaataaagcaggcaggagaaggtagaagagtagacttgctgagtcttccggccttcatctttctcccgtgttggatgcttcctgccctcgaacatcagactcagcttttgggctcttggacttcagcttttgggctcttggacttataccagtgatttgccaggggctcttgggcctttggccacagactgaaggcttcactacttttaagattttgagactccgactggcttccttgctcttcagcttgcagacggcctatcgtgggacttcacctcgtgatcgtgcgagtcaattctcctaataaactccccttcatatatacatctatcctattagtcctgtccctctagagaaccctgcctgactaatacagaaggaaaggcataaatgaagtagtcactcatctcccaatagctgttgtgcgtatgtagatgaaaaggagtacagagttacctatgcaaaatgtggtcattgtataaagaacgacttttcaacactgtgctaggggttatgagaaataaaagagaaggcaaaacccagctcttattcctaaggactttaagtttcagttggaaggcaagttgtcatatgtgaaatgtcaatgtttatcttacttcaacccctaccccactggtcctaaccctgttcctctgtgagtcttccccagaaaatacttacggagatgtcttcaggctgaggagccaaggaaaatttctttgggtattgtacaccataccctcaaattgttctattgtacttaggtcctacgtttaccatttagagctaccaactcattctgctttgagtggaacgttccagaaaaagccttgtttcaggaaccccatcagtcctgggaaaccagaatggttggctatctgagcccatattgctcacagcattgccagtgccagcctgggtgaccaagtgagaccctgtctcaaaaacaaaaacaaaaacaaaaaaagttcctgagagtttcatacattttttggtgatatcagcatgcaaataagatccacatatcacaattggttgatacgtcttttaagtctcttttcatctataggttcctccactatttctttttttttcccattagaattgattagtaaagatactagttaatttttcctatagagtttcccactgtctatggattttgctgattgcatcctagtaatatatttcaagtaaactggtagttagatctaggggcttgttcagattcaggtttgattttttagcaagacagcttcataagtggtgctgtgtactttcatcagaggtacataatatctggttgtctctcttcttatgatgctggcagccattgatgaccattgcctagtccactatttcattaggaattgtcaaattgttaccagggggtccttgctcccagagctcccaagatggtggcaagcctcgcgttctctgacctggggttcttgacctcatggattccaaggaatggaatcttgggccatgcagtgagtgttatagctctattagaagccgtgggtcatggaagagaaccatggaacccagtgactagtgttcagctccatcaggatgaaacccgggcacttagccgtgcaggaacaatggcaagcctttagcctgatcgggagcggcaatgggcaccttgctggatcaggagcacagtggacaccctgctggatccggagggatggaagtcagtggcgggtctgcaacggcggcaaacaccagtggtggatggcgagcgaaagctcagctgtagccataagaaacatggaccaaaagagagtgcagttgcaagatttaatagagtgaagacagagctcccatacaaaggcagggggcccaaaaagggtagccgttgcaggctcaaatgcctgggtttatatcctgatccttgtccctcccgctgtgctctcaggcaacagatgattggctatttctttacctcctgtttttgcctaattagcattttagcgagctctctttactatctgattggtcgggtgtgagccaagttgcaagccccgtgtttaaaggtggatgcagtcacattcccagctaggcttagggattcttagtcggcctaggaaatccagctagtcctgtctctcaaaatggcaatattctatcattctttcttcacccattaactggaatactcctatgaaaagaaactccccatcaacaaattttttactaccccgtggtacaattgtatagaaaagacttcagtgacaactttgctgatagatctccatatgcacctgtgaaaggaaaataaatcttgggaccccaaaatcactaagctaaaggaaaaagtcaagctgggaactgcttagggcaaatctgcctgccattctattcaaagtcacccctctgctcactgagagagatgcatatctgattgtctcctttggagaggctaatgagaaactcacaagaatgcaaccgtttgtctcttatttacctatgacctggaagctccctccccacttcaagttgtcccgcctttctggaccaaaccacaaactaatgttcatcttacatatgttgattgatgtctcatgtctccctaaatgtataaaatcaaactgtgctctgactaccttgtgcacatgtcatcaggtcctcctgaggctgtgtcacgggcacatgaccccaaccttgccaaagtaaactttctaaattatctgagacctatctcagatattcagtgttcaaatttcggtaaccacaaagggattctgagtggaggtacccctgaactttgacaaatctcatattggtgcttggtaccagcatgagcaactttgtggctcaaaccaataggacaatttgctgaggtctgggagcaccccctccagagaatccctgatatccctaaatttggtagagatctaaagtttattttgctgtacaactcccttttttttggagttttacttgcttctaacacggaaggcaagattccctgcttccatgacgatggaaagcaagtacctcctttatggagtttgagctcactcccaacaagaaagacgagtttgagtttttttcctgcttcaaggatagtagaaagcagtcttcaacctgagacccattcctaggtaagttaacaaccagctggttttaatttctccttaccattagagtgctcagtgatcatattgtcggggttttttgttgttgtttgtcctggtctttctcccatcagatttgaccaactccacctgacttggtcaaatccgagtgagaattccaaattatggataacaaagcctctctagtttggcaaaaattcctcgcagctgcaaaagaggaaaaaacaaaaaaagccatgcgcttggattttgtgtttgcttcctgtcttaaaaaacaaatgttctttcgtttacttttcttccactctatacctccttccccctatgccatctgcagtaccaaaaaatctagagaaggcttccaatgacttgagcccctttcaagaaatcagaacaaagataccactcaccccttttggagtgttctgttttccttgtggagttccaagagtcatggacagatttttcttaggtctaaagctctgttttcctgtattgcatgacctgacctttttggctttgggagtaccagaaataaccttgtactatgagagaacttgacctcggcatgtgtaatggcagacgagagctacaaaattaggggtggctgagcacagtttacaggaagtggtcttcactgttgttgttgttgtttccctcctaggaaactgttatttaaggatcttaattctagttcagagatgtattctaaagggccttctctattgctttttctcccaaaattaatctcgattcagcttgtctgtgcgcatttgcgtgaggaactgaactgttgttttcatagataaatgagggactgagttttctcagctctgaagagaaagggcattttgatcctcccagccaaaaggcactccagggtgtatttcctggataagccttttttttaaattaatttttgttggggatttccctgtagggccactgaacgtttcgaggggtcaatcccccagacattcccacatggcccccagtcaaatcagctgttatttttctattaagataaaaaccactgtttggatccaacacggtttttttttgcaagctggtgaatttgtatttacctcatggctaaggttctgaagtaaaagcgataggatctttgtgtgtgtgtgtgtgtgtgtgtgtgtgtgtgtgtgtgtgtgtgtgtgtgtgtgtgtgtattttaaaggcctttataatttttataattttatgtttaattggcaattaaatccgttttaatttccctctagcacaccaaagtatttatctccataccttatgatgtatatcttgctatttgattttcacctgacttgtttcctttaatatgcaaatttaagcctatttagctgacaactgcctagggtagtgaaacaggttatgaagaatttgaaagcccaagatagggaaaaataaaaggtttttatgactctataagatgtacattctatcagcatgcctaatacgtctatgtatttatgtacccaatgtttcactactgaaaatatatgcaagagctctaattaattggcttaagaaaataaaagcacttgaatcaaatactttatcaggaaaaaacaaaagactagtcaaatgctttttcaagtttacataacttaagtaaaatcttcaataaataagctagctttaaaattattggtaaagtaatattaaaaatgtcttaagaattgccagcatacatttttgtttgcatttattaatcaagcaatttcatacttatccctgccaaatactacaaggtgtcaaaatttggcataggggttacaaaaccataaacctagcccaaaacagaatgatctttgtcatgtaatctttaataaataagacattgatattagtttaatgaaaatagcaacatcttgaatttagtaagattgccataacttctaatcttctggctttatgcagtccagcccacaggcagtaaggtttgttttcagaagggactgttaccatctttgtctcaaagtcaaactgtaaattgaattcctcccaaacttagtttggcctgtgctcaggaatgaacaaggacagcttggaggttaggagcaagatggagtcagttaggtcagatcttttcaactgtctcagttataattttgcaatggcggttccataactttaaatgatgactgccgcagttttcataaataatctaggtaaacaattgaaataattaggtagacgtaatgggatgaatacttgtagacaacaaactcatcataatttagactctaaagttatattaaattaaataatagatatttaaaatattaaaagtacaaaaattagccaggtgtggtctcgtgcacctgtaatcccagctacttgggaggccgaggtgggagaattgctcgaacctgggaggcagaggttgcagtaagccaagattgcatcactgcactccagcccggacgacaaagcaagaccctatctcaaaaaaaaaaaaagaaaagaggatttattaaaaaaaaaactttcatatgatcaagttgtctattaattaaagggaaattataatggtctttctagagattgggcttgatgtaagaaaaaaccacttacacactaaataattggttagaataatgaaattttcttaagggattgatttactcttaataaattatgagagattttaattttttaacccaaagttcaatttgtattgcatcttgccatttttggttttctctccccttttaaagggcaagaaatagtaatgctctccaactcatttttcaactcatataagtttttctccttgagttttgtttgttgtggcctgatgctaacaatgttttcttaaaagtctaaaggaaattctttcttccaacataatattctgtgcagtgccgaaggtcttttcttttgccttttggtaactggcctaacagattttatggtttattgaaacaattcctatgctattattattaagttttggtttacttagggaaaaaaatgaaataaaaaaaattttttcattaaggttattatattcatgtatctttctgtatgggcttgtaaagtcattgtgacatagagttacagggctttggctcctggatctaaaaaggacaccaagtcctccgaaatcttaaacgctgacagcaattaaagcctcatcttcaggcccagtagagatgccaatcaaaataaactgcattcctgagacacaggccagaaattaaagctatctaactcctcaaggccagggactattgcagaagaggtgggcatgagattgtaagggccaatgttgagagataaaataagttcagtttctctatgaattaatcattaatgtcgaaggcacactgatggaagaccagcatatgggcccctgtgtcagattaataagtttttcttgaagcattaaccaactccttaataaaggttataaagattataaaaggcttattgaagttatatcttatgctcaagattaaaattttatagattgtttataaaattttgaaaaacaaatttaattggcgtcatgctgtttttattagggcttattgtttggaaaataaagtctcctctctcaaagaatgaaggattttgtctttttttgaaatccttgagttaccagtttggtgaaatgaatggcttattttacaatgatctgtgatatcaagtgttttaaacctttgatatttgacaccttccaaaatcaaattataaattatgtctttttctgatctaattaatcctttaagatattaggttccccaaagtccaaaaatgacataatttggcctatttcatataaacatcatacaggaaacattgtcaagtgtgaaatggtgtttggttttctttgagctgtatctatataaatatgttattggtatgtgttccaaaattatgggaaagtcctataattctgatatgacttactgtacataatcagtaataattataattgttttcttaaattattgtgtgccacagaggcaacaaatttccttgtccattgtgtctttgactatggctgccctaaaacttttttcatccatggacaatttttgtcttgttttcgtcctctttagaaggtagttttataatcagctataaaattctaacaggtgctcttgaatacaagtttctgaaaatttttgagattgtgacatcagaataaaagaaaaattttcaggactcatggagaactgaaatgttcatgaatatcaagcagaacaggaattaactacatggactgacatgcataagtacaataagaatctgttttcatttataacaggacacaatttgagaaactggttattttaccaaagctttgactggaatggtgtgctttcctttaaggaatcaaacttgacttatggagccaataaaagtcccatgggaaaactggccttataccttgtctacacagtccctgtacagggttcctgacatgtggtaagtaaagaatgccactttctgacaggtgcaggagccctaagtttatcttggaacctcaagaggggaggaattcacccaattcatagagtggtttttttgtttgtttgttttttggcataatctcgatctgttgcccaggctggagtacagtggtgtgatctcagctcactgcaacctctgcttcccaggtccaactgattcacctgtctcagcttcccaagtagctggaattacaggcatgtgccacaacaccctgctaaatttttttgtattttgtagagacaggatttcaccatgttggccaggctggtctcgaactcctgacctcaagtgatccacctgcattgaccccccccaaattgctgggattacaggcatcagccactgtgcctggccccaactcatagatatttgatggtacaaatctatggctgggcttggctttaaaaaagtcttatctgagattctttctatggaacaaagttccatcaatgccaatttaaaagcctatgtaaaaaataataattcttgctgcactgtatacaaataatcaggccaagtataataaagcaaatcagtccttccatgatttgtctttagtaaagatggaaaactggagagagaaaaattatgtttcaaaaactataatacacctgttgttagattccagtcttgcctaatgtttttcagttgtttttttttttttttttttttttttttagatggagtcttgctctgttgcccaggctggagtgcagtggtgcgatctcggctcactgcaagctctgcctcctggattcacgccattctcctgcctt[134 bp omitted]ggcttcccaaaatgctgggattacaggcatgagccaccgcgcccggccttttcagtttttattattttctacagtctggaccaaattctattttttcttggttacaagtcttcaagataatgttttcaatttttttccttcttttttcccccatttttcctaattaggagtcattgaaaactaagcgtgctttcataaagccctgtgaactgaagtcagacaacttaaactttagaagaaaataacagcaacccatttacatacataaaccactttcaaacctgcctactgattatggacttcagagtaatatggcttataccaattttccaggattgttcttttgtttgttgttgttgtttgtttgttttttgtttttttgagacggagtttcactctgccgcccagactggagtgcagtggcgcaatctcagctcactgctgcctctgctcctgggttcaagcaattctcctgcctcagcctcctgagtaactaggactactagttactagttagttgtcgtaattactaatgcccggctaattttttgtgtttttaatagagacagggtttcaccatgttgtccaggctggtgttgaactcctgacctcagatgatctgcccgcctcggcctcccaaagtgctggtattacaggcgtgagctaccacacccagcctgttgttgtttttctccctattttcacttcctaggatgtgaaacttcacaacctgctaaaaatgaactttcctaataattcaggacctaaccatctagaaataaaccaaccgagccataagagatcagacgaaacctgagaccagagactcattttcttctgaaatgctttctccaaaagatttttaaaaagaaaagggggggaatgtgaaaggaaataaatcttgggaccccaaaatcactaagctaaagggagaagtcaagctgggaactgcttagggcaaacctacctcccattctattcaaagtcacccttctgctcaccgagatgaatgcatatctgattccctcctttggagaggctcatcagaaactcaaaagaatgcaaccatttgtctcttatctacctaggatctggaagccccctcaccacttcaagttgtcccactttttcttcgagttgttgtccccgctttctggaccaaaccaatgttcatcctacatatgatgattgatgtctcatgcctccctaaaatgtataaaaccaaactgcactctgaccaccttgggcacatgtcatcaggacctcctgaggctgtgtcatgggtacatgtcctcaaccttggcaaaataaaatttctaaattaaccgagacctgtctcagatatttggggttcacataactcaggctttagcttccagtgtttaaaaccacaccttgagtcttcctttccaaagcatgccttccatgctagtgtgtctggatccagcctcaataacagcaaaatttgagagaaaagcttaaaaatatataaaatatccatgtaggaggcctaacatccattcatatgaaattccagaaagaaagcaaaaacaagagagggaaagaggtaattttaaaaacagaaaaaaatgtctcataactgaagaaagatctcagtttgaaagatcactgagtgggaattaggatgaaagaaaaagcctcacacctaaacacagcctcatgaaactctaaaatatcaagaataaagggatgatacttaaggcttctagaaaaagggaaaaaatgatgtacaaagaaatggaaatcttcattagcagcaatagatgtaaacaaagcaaagcaaaacaaacaaaataattttcactcgtgtccgtgcgaagagaccaccaaacaggctttgtgtgagcaacatggctgttgatttcacctgggcgcaggcgggctgagtccgaaaagagagtcaggaaagggagaaagggagataggggtggggccgttttataggatttgggaaggtaatggaaaattacagtcaaagggggttgttctctggtgggcaggggcgggggtcacaaggtgcttagtgggggagtttctgagccaggagaaggaaattcacagggttaatcactcagttaagatggggcaggaacaaatcacaatggtggaatgtcatcagttaaggcggggcagggccttttcacttcttttgtgattcttcagttacttcaggccatctgggcgtatatgtgcaagtcacaggggatgcgatggcttggcttgggctcagaggcctgacattcctgccttcttatattaataataaaaataaaacaaaatagtgttgaagtgttggggcggtgaaaacttttggggcttggtatggagagagaatgggcgatgtttctcagggctgcttcaagcgggattaggggcggcgtgggaacctagagtgggagagattaagctgaagggaggtcctgtggtaaggggtgatattgtggggatgttagaagaaacatttgtcgtatagaatgattggtgatggcctggatacagttttagatgaattgagaaactaaatggaataagagaaggagaaaaacaggtataaaaggtctaagaattgggaggacctaggacatctgattagagagtgcctaaggagattcagcatagtcccgccagcaaagattatttatttacttcaagagtttagagtggcagtttggggatagcaccaggagatatcagctgtgatggcttggaaaagcagtgtaaaccggcagtgtaaacaagagcagggcatgtatgagtagttgagaacggtgaataggagtatgactagacagaagatagtagggatgacaagttttttgggggcacagtctaagttggtctggtgtctggaatgagactggggcctaataaaaaggagcgtctatacaggagcttaaatgggctgtaccttgtagcattctgaggacaggcctgaattctgagaagctaaaatggtaaaagtattgtccagtcctttttaagttggtggctgagcttggtgaggtgtgtttttaaaagacctttagtccgttctacttttcttgaagacagaggaccgtaagggatataaaggtttcactgaatactaagagcctgaaaaactgcttggctgatttgactaataaaggctcagctgttatcagactgtattgaggtgggaaggctaaactgaggaattatgtctgacagaagggaagaaatgactatggtggccttctcagaccctgtaggaaaggcctttacttattcagtgaaagtgtctatttagactaagaggtattttagtttcctgactcgggacatgttgagtaaagctaatttgccagtcctgggtgggggcaaatcctggagcttgatgtgtagggaagggagggggcctgaataatccctgaggagtagtagaatagcacatggaacactgagaagttatttccttgaggatagatttccacgatggaaaggaaatgagaggttctgagaggcgggctagtggcttgtactatatagcatagcctgcctttgctggtgtgtggcgattaggcctgatggaactgccatcaataaatcaagcgtgatcagggtgaggaacaggaaagaaggaaatatggggaaatggggtgaatatcaggtggatcagagagatacagtcatgggggtcaggtgtggtatcaggaataatgtgggaggccagattgaagtccaggccaggaacaatggtaattgtgggacttaaagagtgagtacagctgaaggagccggggagcagaaagtatatgcgtcaggtatgaggaagaaaatagattttggaagttatgagacatgtagagagtgaggtgagcatagtttgtgatttttagggcctctaacagtattaaagcagcggcagccgctacatgcagacatgcgggctaggctaaaacagtaaggtcaagttgtttggacagaaaggctacagggtgtggtcctggctcctgtgtaagaattctgactgcactaaccatgcctaggaaggaaaggagttgttcttttgtaagggattgaggtttgggagattaatcggacacgatcagcagggagagcacgtgtgtttttatgagaattatgccgagataggtaacagatgaggatgaaatttgggcttgattgaagtaatgggggctgtctgtgaagccttgcggcagtacagcccaggtaatttgctgagcctaatgggtgtcagggtcagtctaagtgaaggcaaagagaggctgggatgaagggtgcaaaggaatagtaaagaaagcatgtctgagatccagaacagaataatgggtagtagaggaaggtattgaggataggagagtatatgggtttggcaccaaggggtggataggcaaaacaatttggttgataaggcgcagattctgaactaacttgtaaggcttgtctggttttaggagaggtaaaatgggggaattgtaaggagagtttataggctttaaaaggccatgctgtagcagacgagtgataacaggctttaatcctttcaaagcatgctgtgggatgggatattggcattgatcggggtaagagtgattaggttttaatgagatgttaaggggtgcatgatcggtcgccaaggaaggagtagaggtatcttatacttgtgggttaaggtgggggatacaagaggaggacgcaaaggaggctttggattgggaagaagggcagcaatgagatgtagctgtaatccaggaatagtcagggaagcagataatttaaagtgtctcggcctaataagggaactgggcaggtggggataactaaaaggagtgcttaaaagagtattgtctaagttggcaccagagttggggagttttaagaggtttagaagcctggcggtgaatacctaacaacagttatggaggcaagggaaacaggcccttgaaaagaaggtaatgtggagtgagtagcatccatattgattaaggggacggacttaccttccactgtgagagttactcgaagctcggcgtctgtgatggtctacagggcttttgaggtgatcgggcagcgtcagtcttcagctgctaagccgagaaggagtcagtcagagagccttgggccagagttccaggggctctgggagtggctgccaggtgagttgaacagtccgatttccagtggggtcccgcacagatgggacatggcttaggaggaatcctgggctgcaggcattccttggcttggtggtcagatttctggcacttgtagcaagctcctgggggaggagtttctggaggaacgcctggctgctgcggttcaggcgtttagaagttcttgtgtgctggagatgtggctggggtttgtctcacagtggaggcaaggaattgcaactttttttttattattgtacaccttgaaggtgaggttaattaagtcctcttgtggggtttgagggccagattccaatttttggagttttatttaatgtcgggagcagattgggtaataaaatgtatattgagaataagatggccttttgaccttttagggtctagggctgtaaagggtctcagggttgctgccgaacgagccatgaactgggctgggtttttatatttgatgaaaaagagcctaaacgcttctgatttgggataaagaaaaaggagcattaaccttgactatgcctttggctccagccacctttttaagagtaaattgctgggcaggtgggggaggcctagtcacagaacgaaactgtaagccggaccaggtgtgaggaggggagatgataaaaagattacagggtggaggagcggaggctgaggaagaattggaacctagcttggcctggcgaggaggggagaggtcagatgggtctgtagaaaaggaagattagagagactcagcgacgcttggggttgggactgaggggacaggtgggagggaaagaaggaagatttgggacgagttgcactgggcacagagactaggaagggactgatgtgtaaaagaatgcctggatgtcaggcacctcagaccatttgcccatcttacaataagaattatttagatcttgtaggatggaaaaattgaaagtgccattttccggctatttggaactactcgagtttgtattggggtcaagcgacattgcagaagaaaataagatgcttagattttaggtcaggtgagagttgaagaggttttaagttcttaagaatataggctaagggagaagaaggaggaatggaaggtggaaggttgcccatagtgaaggaggcaaacccagagaaaagagagcatagagacacggagggaaggggttcaggggttcttaccctccagaaaagcgggaagggtggttggggcatggaaataagggattggggcacagagataagaggttggggtgcagaaataagggattggggcacagagataagaggttggggtgtggaaataagggattgggggttcttgccccctagaaaagcgggacttgctgctaagggtgaaggagaaggggttgaggggtacttgcccctcccccagaaaagcagagaaggggtagagacacagagagaaggggttggggtacttgccccttccccagaaaagcaggacttgccactaagggtgaaggaccaaggcaggcatccctgtgtggtctgacacctttgaaacatgggtgaataatcagagaggcgtccctgcaatgattaaacacctagggaaggctgccttcccagtccatgaccggcgccggagttttgggtccacggataaaacgtgtctcctttgtctctaccagaaaatgaaaggaattgaaattaagagaagggagagattgaagggtggcaccaagattgaaaggagaaagaggttgagggatagtgagggaagctggagaagagagtaaaaagaggccgcttaccagatttgaaattggtgagatgtttcttgggctggtcggtctgaggacctgaggtcgtaggtggatctttctcatggagaaaagagcaggagaacaggggattgatctcccaagggaggtcccctgatccgagtcacggcaccaaatttcactcgagtctgtgtgaagagaccaccaaataggctttgtgtgagcaacatggctgtttatttcacctgggtgcaggcaggctgagtccgaaaagagagtcagcaaagggagataggggtggggccgttttacaggatttgggaaggtaatggaaaattagtcaaagggggttgttctctggtgggcaggggcgggggtcacaaggtgctcagtgggggagcttctgagccaggagaaggaaattcacagggttaatcactcagttaagatggggcaggaacaaatcacaatggtggaatgtcatcagttaaagcggggcagggccttttcacttcttttgtgattcttcagttacttcaggccatctgggcgtatacgtgcaagtcacaggggatgcgatggcttggcttgggctcagaggcctgacaataatacctgtgaattttgagggaaaatgaccttgaacctagaattctatattagtcaaatataagaataaaaataaaaagacatgtttaggcatgagagaactcagaaattttacccctagccctcttctctgaaaaaaattacttgaggatgtattctaacaataaaaaaaaaaagagatccaagaaagagaaagacctaggatgtaagaaacagagatgataacccaggaatgcaatgaaaaaaaaaatcctaaaatggtagctgtgaaggagtgaggcatagaaagagtgggtatatgttagagcatttaacaagtcgtctatgtgaacaattggaaggtatcagtaatatggtgacaaaggcacctatatcttctgccaaaaaataattagaaattttaagaaaggaaaactttcccaaaaagtcatgatccatatatcaaacaatctaaaatgtggcataactcagcaattggagtgtaagaaaagaaaaaccatttgaactggaaatttgtactatttcccttcaagtggcctaggtatagggatacaggattacatctcctccagtgatcaaatcacacattctgttttctgcaactaataacatttacaaaattataattttgtaagtgatgtttattggctttcagaatcaacctatagaaaaagtatgaaagacaaatatagttatagaatggaatgtaaatatgaaaatggtttaaactttaacaatgttaaagtactcaaataaccaggaggagtggggagtaatttcttcatttgacacagtaagcctcaagaagtaagtgtaaatggaagcttaagtacattatgcaaagtgttaatggtaaacaattgaggagctaacaaaaaagaggaaagtcaatactgcttaaaggaaataaatcaagatttcaaagtaaaagcatcttattaagaattatggaaataaccaacagaaaaaaaaatcccagaaatggtcaaaagaagctcaaaggtatcaaatgatactctgattagtaagactgagggtaagagcaggaagaatctttgtacttttaattttgtaacctcccacatagctattccattcagtcattcattccttcagcaaatacttatagaacattattattgtaccaggcatgattcgaagcacagggatacaggatagacaaggcggagaatattcctgccctcaaggaactcatattctagtgggcaaaggtatacaatagacaagtaaattgtttccccaaaaagataggtacaaatattaagtgcaatgaaaattataaaacaaaataaagtgataataacttgagtgatcagggaaggcctctctgaagaagtaaaatttgagctaaaatacttttttatatgagaaacgtataggatttcttttcttttttttttttttgagacagagtttcactcttgttgcccaggctacagtgcaatggcacggtcttcgctcaccacaacctccgcctcctgggttcaagcgattctcctgcctc[134 bp omitted]cttcctccccagcaaccagctcaacaaaccaaggaatttgcggagaggcagtctttgtcaaaccacaaaagatcttgttacacccttagcccaaagcaataattacctacctgcctcagatttacccagagagcatttccaagtgattgttcccagcacaaggaagacatgctgcaaagtgacttgttggaaaatgttcaagtaccactttctttccctatgattccctaacccgtgtccagcagcaccaggaagagatccaggctcatctcaaggtggggtctccagagaagcatagtgaagggagacccactacataggcagaactgcctgttcatacctgacagcaaagccctatatgtaggtcctaagtctgtgctacgatgctattgtagctcgttaccaatgctcttttgaaacacacagcatgaagcaccttgacttactcaacatcctgtactacactgaggcatgtttttggccacaggaaaacaaaaaaggctaaagaagctcaacagagctaccccatcctccctcaatcaccaagcattcctaggagacgttccttacattcctcaccaactctctgccaactgtggtcatagcataataatcattgaagtcaacaccttcatgagaacaacccactttctctcttcagctggaccactttctgccccagttatctctaccttattcttcagagacataattgttccacctctaagacagcctaccctgtaacatctgactggggagcccaatttgtgcaaagtttctatagagcacacttctgatccaccatgtccaaatccacttgtccattgcccacaacaatcaaactgaacaacagccagatagattttggaggagacttctggttgtcattcaccttcaacaaataagataactgggacacacacctcccaaatgctaaatttgcttaccatactctgcacccatctattagaggaccctttttcatagtcattgcagctttctttctcataccaaccagctgcatcaccatcttttgctttcggtcaacagatgtcaattatctattatgcaccagacactgtactggatgtgagggtcatggctgcccataggccatgaggtgactgcgtgcaaatttgaaaaaggctctccagatgcacacctctgcaccaggttgcatgaattggtgagtacagcgaaggctggatttcaatccttactgatcctctcaaccagattcccttgtacagtgaacaattgtacccagcaggcatatggggattgaacaataagagtcttgtggctaactggaagcattctagattcccccaggaaggccaaagggacatctgcattttccaaatatttcatcaagttctcctactacagtgtctgctccacctgctgctattacatacccaaggaccactcccagggcccagttacatatctggagattatgaaccctgtcacctttgcctccagcttcccctttttcatgtatacccacctcatctttcaccattcctcactagactcagctggcctcaactccacccagcacctcactgtgtactttatacccataggatccaatgttgcacaataagaaacccaaaagacacaatacgggaaattttggagcaagacactacctccagtactgatcttacctcaccccatttagcagggaggaagtgaaaggcaggaggggacatgtccaatcctgctctttcttaggctgatcaagtcacccccaaatagatggccaacctctactgagaggggccttcacatccctctgccttggccaaacactgtgttctttgtacctcattcccagattgagccagctgaagcaaaacccagtgaagaccacctttaccgttttttaatagaatacataaaaccccagtctacagcatctgccttccccttttccaccaccatcgaggaacactggcagataggtaacttactaagaggcctcaatgaagtggtctgtcccagagaaagggcaggtttgacccaagacaaattccagatcctctgcttagagccgcaggaagaaatgctgaaaccaaaccaagccaaacaacagaaaccccagcagtctttcatctgctctaaatctagatgatttcaaaagtgtgtccatcatgaaaagatccctaggggtttgcttgtactagaagagcataaacatttacattgccttttttctgctgacagaacagtgagagggaagggcctcatctggcaacttaaagcaataccattcaatcatcccaaagccagttctttgtgtatgtaagtagctgcccttgcaggaggcttaaggtgctgggagctcagggtcctgagtcaaatgatctggcttcaaatctcacctctaccacttacagtttgaactataaggaagctgtatggtgttacagaaagtacacaggctctggacacttggctgccaagtgtaaatccctgctgccccacttaccagctgtgtggcctttatgatatacagtgcctcagtttcctcatctctgagatgatagttatactccctgtaacatcacgggactgttatgaggcttacatgggaccatccacaacctcacctacagtaaatgtttactaaatcttagtgattattattccattctgagtctatttctcattccttgaaaatgagaagagaaaggggcactgctctgcataatcatgtgaggcaccatcgcccctgtgagctgggaaagttgggagaaggtttcttttcttccatttggatttagacggcattctctctgagaatctgttgtttagcctgaagagatagacgtgcgtatgtgtttcatccaaccatcacccacgggatatcaggaaaaacaaaaaagcatttatctctctgtgacccctactgatggggacctttggaaagcgatgacacctggaatgccagagcctaccctaacctgtccatttggaaggctcagagccatatgccaggctgaataactaagatgtgggccagtgggcttctagggaagatagaggtgggacctggggcaagaccaagccctgtgagtaggtagtgggtggagcttcatttgatgggttgaaagaagaggaaaaaagtgaagctgaattcaaggaagaagggcatgagggttctctctgtgatgggcctctctggtgattttctcttggtctacagacatggacatgggcagtagattattttttaaaagtccccatacttgaaattcctttcagttattcacaggccttctgcaaaatctgtacaaccctggtggtgatgttgggaagtataaatgagaggacagtataggaatgtatggtgtcccctcattcactcaccagtgtctgtttatccttcttagaaggggacttgagtgctggatttctggaggagatcagtggaaaattgagtgttggtccatggaacagcagagaagagtagccgccagatgaatggctcagggagggatgtgggcctaaccctgtactttgtgatatgtatactagaagaaaatgactggtaaaggaggaacagcgagatgacattggagctattgtgtatctttgggtgtgttacttaacatcctggtgcctcagtttcctcatctgaaaaatgaggataatgatagtacctagcacataagactgttatgaggataaaatgagttaacatttgcaaaatatttcagtgaccagcacacgttaaccatattagaagtgtttgttaaataaaattaaagttcaactgacagaagtgtggagtgactgataaatgatatattgaaaatgcagagctgggcagtaaaaatttatcttcctcttcaggggaaagacacaagtattctggccacgagaatgtgtactccaatatggagcagggggccagggctccactgctttccatgttaagcttattttcccacagaggaccagactccaccatggtctaatgcacatttgtttcccgtccagccagaatacaaagcagaaaggtgattccaaccccaagtgaagaagaatttccttcttgaaatacccttgcacatatgcacaaacatacatcaacaagggtgttcactgcagcatttcttgtaatagtgaaaaacaggagccaatagaaattacaactaacaaggactggccgactgataaagattaaaccaaaaaaaaaaaaagaggtgcatgtatgtggatgtgcactgataagtagccaaaatatactgtttcatgaagaaaatagaagcagaatagtatgaataaatgtcatcttgttaccagtggaggatatccaggttcttggcattttgaacaaagaattggacaaaatgcataaacaaagcaaggaaagaatgaagcaacaaaagcagagatttattgaaaacggaagtacactccacagtgtgggagcaggctgagtagaggctcaagagccctggatacagaatcttctggggtccaagtaccccctagagtttcccattggacactttgtgctcacctcatgtaaataaagtggtggcccgcaatcagtgtgattccaatcagaggctgaagtgaagttacaaagttacacccaattagtattggttgcagcaaccaattaggggctgaagtgaagttgcaaagttgccctcctatgcaaaaagcaaccaatcagaggtactttcaatttcccatctgtggtgcagaaaaggtgggggtttgcaaaggcagtagcctctggtccttttgttacttaggcgtggaaagttagggttttcctttcaatttagttctaggaagtcagcatgaaacagctttaggttccctgcctccagacgttattctcctgcctcaatctcatctgtggggggtgtgtgtgtgtgtgtgtctgtgtgtgtgtgtgtatccctttcagacacacacacacacacacacacacacacacacacacacacggtgtttatccacccagcaaaaactcctgggtggataaacaagaaaatggtaacagtggttacccctgcggaatggagctgcggatgagggtaaagggaaaggagatttcacttgaattttgggagtttatttttattttggcttattttcacaataaaactagttttttgtgttttttttttctgattatataagcaatatatgtttattctttttttcatattttaacttttgatttggaaataatttcagacttataaaaaacttgcaaaaacagtacaaagaattcaaatatctgccccctaccagcttcccaaatgttaacatcttatataaatcaaacccaggaaattaacatcaatatgatactattgactaatctagaggctttatgcagaagttgtcaattggctcactgctgctctttttctggtctaagatccaatccaggatcccacattgtatttacttgttatatttcctcggtctcctgcagtctggtacagcttctcggtctgtctttgtttctcatgacctggacactttagaaaagtaacgcctagttattatgcagaatgtctctcaatttaggtttgtctcatgttttcttatgactaagtacaggttatgcatttgggaaaagaaaatcacagaattaatgcaaggcccttttcgctgcatcctattaagagacacacaatgtatatgtctaattactggttatgttaactttgaccacttggttaaggggtgtctgttgggttgctccactgtaaatttactccttttcttttccaaattagtttatagcttgtggagagatagcttgagcctatatgaatatcctgtttctcatcatactttgcccactaaccctttgatgattcttgcctaacacaattattactgtgatatttgtcaaatggtgattttctatttccgtcattccttctacatttattaattggcattctactgtgagaaagtgctttcccttctccctatgtatgaattcaattatttatttatgtaactatggacttgccaacagaatgtattgccgtactttttaatttttgctgatctgatagggggaaatgatatcctggtgttgctttaattgcatttacctaattatatgtaaggttacaaggttaaggagctatttactgatgatagataattgtctgttcacgtatttctccattttcctattcagttttggggacctatgcccatcaattttgaagcattatttgtagagtcacaattttagcccctttatctgtgatgcatattgcacatatttgcttccagtttctcagttgttttttggtgttgattatgatgaggctttttgccatggaattttaaaatgtagtcaagtttatccatttttttcttttattgcttctagattttgagtcatgattaaagagcctttccctacaccaagggtaaaagggaatttgttcacattttctttttttttttttttctttttttgagacaggatctcactctggctcgagtgcagtggcgtgatctcagttcactgcaacctccaccccccaggctcaaattgagaggtgacagcgtgctggcagtgctcatagccctcacttgctttcggcgcctcctctgcctgggctcccactttggtggcacttgaggagcccttcggcctgccgctgcactgtgggagcccctttctgggctggccaaggctggagccaactccctcagcttgcagggaggtgtggagggggaggcgcgagcaggaaccggggctgcgtgaggcgcttgcgggccagctggagttccgggtgggcgtgggcttggcgggccctgcactcggagcatctggccagccctgctggctccgggcaatgagggacttaggacccgggccagtggctgtggagggtgtactgagtcccccaccagtgccagccgaccggcgctgtgctcgatttctcaccgagccttagctgccttcccgcggggcagggcttgggacctgcagcccgccatgcctgagcctcccacccactccaagggctcctgtgtggcccgagcctccccgacaagcaccaccccctgctccatggcgcccagtcccatcgaccacccaagggctgaggaatgcgagcgcacggcgtgggactggcaggcagctccacctgcagccctggtgcgggatccactaggtgaagccagctgggctcctgagtctggtggggacgtggaaagtctttatatctagctcagggattgtaaacacaccaatcagcaccctgtgtctagctcaaggtttgtgagtgcaccaatcgacactctgtatctagctgctctggtggggccttggagaacctttatgtctagctcagggattgtaaatacaccagtcagcaccctgtgtttagctcaaggtttgtgagtgcaccaatcgacactctgtagctagctgctctggtggggatgtggagaacctttatgtctagctcagggattgtaaatacaccaatgggcactctgtatctagctcaaggtttgtaaacacaccaatcagcaccctgtgtttagctcaaggtttatgagtgcaccaatcgacactctgtatctagctgctctggtggggccttggagaacctgtgtttccaaactctgtatctaactaatctgatggggatgtggagaacctttgtatctagctcagggattgtaaacgcaccaatcagtgccctgacaaaacaggccactgggctctaccaatcagcaggatgtgggtggggccagataagagaataaaagcaggctgcctgagccagcagtggcaacctactccagtcccctttcacactgtggaagctttgttttcttgctctttgcaataaatcttgctactgttcactctttgggtccacgctgcttttatgagctgtaacactccccgtggagatctgcagcttcactcctgagcccagcaagaccacaagcctactgggaggaatgaacaactccagacgtgctaccttaagagctgtaacactcactgtgaaggtctgcagcttcactccagagccagcgagaccacaaacccaccagaaggaagaaactccaaacacatctgaacatcagaagggacagactccaaacacgccaccttaagagctgtaacactcactgcgagggtctgcggcttcattgttggagtcagggagaccaaaaacccaccaattccggacacaaaatgatcttctcacctcagcctcccaagtagctggtacccaggtgtgtgccactcagaggtgacagcatgctggcagtcctcacagccctcattcgctcttggtgcctcctctgcctgggctcccactgtggcggcacttgaggagcccttgagcccaccactgccctgtgggatcccctttctgggctggccaaggccagagccggctccccaacgtggaaggaggtgtggagggagaggcaccagtgggaaccggggctgcacgcagcgtttgcaggccagctggagttccgggtgggcgtgggcttggcgggccccgcactcggagcagacggctggcccggccggccccgggcaatgaggggcttagcacctgggccagcggctggggagggtgtactggggcccccagcagtgccagcccactggcgctgcgctcaatttctcaccagggctgagctgccttcccgtggggcagggcttgggacctgcagcccgccgtgcctgagcctcccaccccctccgtgggctcctgtgcagcccgagcctccccgatgagtgctgtcccctgctctactgcggccagtcccattgaccacccaagggctgaggagtgcgggcgcatggcgcaggactggcatgcagctgcacctgcagtcccggtgcagaatccagtgggtgaagccagctgggtttctgagtctggtggggacgtggagaacctttatgtctagctaagaaattgtaaatacaccaatcggcactctgtatccagcttaaggtttgtaaacacaccaatcagcaccctgtgtctagctcagggtttgtgactgcacccatcaacactctgtatctagctactctggtggggccttggagaacctttatgtctagctcaaggtttgtaaacacaccaatcagcaccctgtgtctagctcagggtttgtgaatgcaccaatcgacactctgtatctagctactctggtggggacttggagaatctctgtgtccacactttgtatctagctaatctggtggggacgtggagaacctttgtgtctagctcagggattgtaaacgcaccaatcagtgccctgtcaaaacagaccactcggctctaccaatcagcaggatgtgggtggggcagataagagaataaaagcaggctgcccgagccagcagtggcaacccgctcgggtccccttccacactgtggaagctttgttctttcgctctttgcgataaatcctgctgctgctcactcttttggtccacactgcctttatgagctgtaacactcaccacgaaggtctgcagcttcactcctgcctgagccagcaagaccacgaacccaccagaaggaagaaactccgaacacatccgaacatcagaaggaacaaactccagacgcgccaccttaagagctgtaatagtcaccgcgagggtccgcggcttcgttcttgaagtcagtgagaccaagaacccaccaattccggacacaccaccactcccggctatttttgtgtgtgggtatttttagtagaggcagggttttgccatgctgcccaggttggtcttgaactcctgactcaagcaatccacccatgtcagcctcccaaagtgttgggattacaggagtgagccactgcgcccagcctcttttaatatctgtatagtttcatgtattacacttggatccttgatccatttagagttaattcctgtgtgtggtgtacagattggacctcattttatatttttccagataactagtcagtatacccagcaccttttacaaatctttgtcccagtaacatatatttattctttaaaaattctggtgataaatacaagtttaaggaagaaaaaaatcacaaacaaatcctacccagagataaccgcaaattatgttttggtagactgctctggtttaaatatttgacccctctgaaactcatgttgaaacgtactccccaatgtaacagtattaagaggtgaggcttttaagaggttattgggtcatgagggctgtgccctcattaatggattaatccattcatggattcatgggtaatcatgggactgggtctgttataaaagccagtttggcaagttcttgtcctctcaccatgtgatgccctctgccatattatgatgctgtaagaagtcccttaccagaagtggtccctcaaccttggacaaccagcctccagaactgtaagaaataaatttcttttctttgtaaattacccagtctcgggtactcagttatagcaacaggaaacagattaagacaatgaccatacttccctacctttccctattcatacgcgtgcgtgcacacacacacacacttttacaaagatgggatctcatacatgctgtttttatcacgggcatgtttattcacacttttttttttttgccccatccctaaacataattaacagcctgttatgtgacttttagcacctttagtcatgtccagttattcatatacaaacctattcatacatgcataggctgttcttgttgtttgctttacaaataacaaaacgggttcatactgtatatgcttctcagcattgtatccttgctgcttaatgaaactttgaggaattcctctaagtctgctggtatagacttaattcctccttttttgtttttgttgttgttttttagagacaggatcttgctctgttgaacaggctggagtgcagtagtgcaatcatagcctactgtagctttgaagtcctgggttcaagcaattctcctatttcagcctcctaagtagctgggactaaaggtgtatgccaccacacctagataatttttttttactttttatttgtagagatggggtcttactgtattgcccagactggtcttgaactcctggccttaagagatcctcccacctcggcctcccaaagtactgggattataggcatgagcccatacccagccctaattcttccttttttaatggctaatagtcaatattattgatgtattattaaatactgatgggcattaactgttttcctttgccactgcaaactgagctatcactaacatccttgtacacatatccttttatagtagtgttctcatttctgtggtacttttcaacttaaactcgtctatattgtgaatttttatcatgagcaactattaattttattttaaaaagcaaaatctatcactgtatagagcttgagtttacaatcagatgcatctgaattcaaatcctctaaaactcagacactgctggtgggagtgtgaaataatgcatccactttggaaaaccatttggcatgatttactaaacttgagcatacatatacactgtgagccagcaaatttacttctaagcatatccaacacaaatacatgcacatgtataactcagagaagtgtccaaagatattcttatcacttctatttgtaatagctcagaacagaatattccaaatgtctgacaatagtaaaaatcaatagattgtagtatattctgacaatataatgctgcatagcaccttttctcaaaaatgtgatctgtggatctctgaggagtccccaaaacctttacaaggggtcctcaaggtcaaaatcattttcataacactaaaaggatatttgccttcttcattgcattgacacattgacatttgtactgatggtgcaaaagcaaagatatatatattgccagcacctcagcacaaatcaaggcagtggtaccaactgtactggtattcatggcattcttcaccctacacactcagtaaacaaagtccttgatgaagaagtaaaaatcaattctatcaaatctaatcattgggtacattgtccatatgatgagctaggaagcatgcataaggcacatctgttacacaccaatgtataatggttgtcttgaggaaaagtacttgttagagttgtgagctgaactagacaattttgtcatggaaccctatttttacttgaaagaatggctaacagacgaactacagttattcagatttaggcttttggcagacatttcctggaaaatgaacaaagtgagtctgtcacttaactagcagtatatgctaccaatgataatattggagctttctccaggcacagttcctcacgcctgtaatcccagcacttcgggaggctgatgtgggaggattgcttgagcccaggagttcaagaccagccccagtaatgcggtgagagcccatctctaaaaaatacataaatgaataaaatatatgggagctttcaagtaaaaaagagaattttagaaaatctgtatgagcttgacagcgtccccatgcttaaagactgtcctgatgaggtctgtggtaatagtaacaaatgtgattttttaaataatatatggcaaaatctgttaatatttggaaggtctgcctgcatacctcagtaaaacaatattttccaaaagcatattgttacaaaattaagcatgggtaaaagattaattcaaagtacgagataaattaatggatttttaaagcaactatattaaggaataattgacatacaataaactgcacatatttaaagtgtatgatttgataagttttgatagacgtggatacccgtgaaaccagcatcataacaaagatgatgagcatacctaaaaacccaaaaattagttcatgctcctttgtattctctcacttgcacacttctttctcttctccaaaccatccccaggcaaaccctggtctgtttcctgtc[156 bp omitted]cctgtctctactaaaaaatacaaaaaattagccaggcatggtggcaggcgcctgtggtcccagctgctcaggaggctgaggcaggagaatggcctgaacccaggaggcagagcttgcagtgagctgacatcacaccactgcactccagcctgagcaacacagtgagacgctgtctcaaaaaaaaaaatggaatcatatagtatgtgctctttttgtctagcttcttttactcagtataatcattttaagatttatccacattgttgcatgtagtatttcactgcatggatacaccacaatttatgcattcacctactgatgggtatttggtttgtttctagttgttggctattataaataaagatgccttgaacattcatgtacaagtctctgaatgtacataggctttcatttctcttcagtaaatacctaagagtagaatggctgtgtcatatggcaggtgtatgtttaacatttttagaaactgccaaaatgatttccaaatgggttgtgccattttgcagtcccaccagcagtgaatgagagttccagttgctccacatcctcatcaacacttggtatggtcagttaaattacttggaaacagtttgattcttctgggtttgcttttgtggttggttaggtgggtctgcaacagcacttagtcttggctagttatttcccattacttaggcaagacctcctgactactcaatgtcccatgaattatgagtttctccagtctgcctggagggaagaagcactatttctggccctatgtgagcacaaggcacagttccctctaatcatgtcagatggttatttgccacccttgagtagttttctcacacatacatgctgatcagtactctgctgaatactctaggtctttcttagagtagctctttcctctctggtgttctgtcctatgagctctcctttcttggtctcccttgaccttcagttctgtctccttaattcaaggaggtccaccaggctctacttcagtacccttccctatgtcactttctgaaattttctcaaggaaacagactaaggttatcatagggctccccttgtttgttcccatctctctgggattactgtccttcattgcctaacgttcaatgtcttaaaacccattgtttcatgcaggagggtatacctgggttctgttactctatcttggccatgaaacctaagtctcccattcttttttcagtccaggaaactgaggcccagaacaacaaattggcttgcccaagtttttaccagttaatgaagaagccacagctagaaaccaacacctcctgacctctaatctgaagtcgagacagggctttttcttatctttccagcttcagagatggcttgacaacagaaggttaattaatcagccacagacaaagtaaatatgcatgacctatggtctctgaaaggtacagactagcctgcccacccatccttgatcaatcagcaaatatttattgtgcaccaacgtggaatgccccatatgagacattgctggggacagaaaatgatgcgccactatctctgtggacaagggctcaagtctagatgggagaaagcctgcatgtgaaacatgtccatctttacattctcatatactgtgtcactcaactccccagccaaaagaatcaagaggcatcacaatttgtgggcttttctcaggaaaggcttcccagagaagggaggacttggaatcagaatatgtgatatgcccttactgaggaggatggtaaaggcaggacattatctccctatggctcttgttaaaaatatactcataacttcagagggtctttggctatgtgaaaagcctaagctttgggataagggaagaaggtgatattgtccttaaccagagggcagactaagggatttgatggaaatcctgtggtgaggaagacgcctcatgggccgcccccgtctcctactgcagtgctatgaccagggctgcctctacgctttcttagcaaaaacaaatactcccaagtagattttttaaaatgtgagaacagactattcctgcattctttatctttttcctgtctctttccatccattcttgcttcataacttttaacaggaccattgctcttcactttagaggagataacatgttactatgtgtgtgtgtatatatatatatatatatatatatatatatatatatatgcaagtgtcttaccaggtcacgaagagctgagctgtccacttgaagctgcaggacaaacactacagacctcaggcattttaataattcagtgagcatgtattgagcacctactatatgcctggaattatgtttggggctgggtactcacaggtgtctaagactcgtggcttgctttatctagttcttggtctagaggggaagacagacacttggacaataatgacacgagtcaaattctgaaataggagtaagcacaaagtgctctgggaacatagaagagaatgatgagctaagatgccaaggcgaggaagtaggtcagtgtctgggcaggtgggcgggtgtgtgggagcaggcatttcgactgggtcctgaagaatcatcaggaatttaactgacagtaaaggagagacaaagaagggaggttattgcaggtaaaggaaatagcatgaatagtggcagaaatgtgtgtgtgtgtgtgtgtgtgtgcctgcctatctggggaatgaaatggctggaccatgggacagagtagcagatgggtctagaaacagattgaagccataaataacacactaaagggtttgccatgcaccctgaaaagtaggtcttctgcctcccaaacaagcatattattttctgccaccactcccttccctacttgccttgtctgtgccctcccattatcgtcatttcccacccaaagtgatcaactttttttttttatcacatcatgcatttacacatttaccaaattgattgggtcccttccatgtaccaatgtcatgtctccttggaacactcattcggacctgctgcttgttgaagtatgaaacccagagactgtggaactatgcatggtctccatcgtagtgcctcctgctgccatcattcctgtgctcttctggggtttggctaagacctctggaagtcagccactgcatacactgtgagtattctaacatatttgccaggactctagtttatactcaatgccatatttctcactaatctttttcttttggaaaatataattatattcactaaaatatgttatttatttatgttaacatgtaatgggttatttaattaataaatatttttaaatttttcccaggctggagtgcagtggcgcgatctcggctcactgcaacctccaccttccaggttcaagcgattctcctgcctcagcctcctgagtagctgggattacagatgctcaccatgatgcctggctaatttttatatttttagtagagacggggtttcaccatgttggccaggctggtttcgaactcctgacctcaggtgatctgcccgcctcaacctcccaaagtgctgggattataggcgtgagccaccatgcccagcctaatttctaatacagtaaatatcaatggctataacccatataagcaaaatctatttggttcctcaataatttgcatacatttaaagggatcctgagaccaaaaagtttgagaactgctgtgtaattctcaataaaaataaataaaaatgagcaactactgctactcacaacatttctaaatttcacaaacatagagcaaaagaagccagacacaaaagcatatatactattacatcccacttatataaagttcaaaaccaggaaaaactaatttatgatgttagaaatcaggatgttggttacattggggtaagaaagaggggtagtaatttagaaaggaagcatgacgcttctgggatgctgccaatgttctattccttggcctgagtgctaatttaaaaagtgtgctcaatttgtgaaaattcattggtgttaagagcacttttctgtatgtgtcatttgctttgttttttaaacattgaaaaaatatgactctgtaaatcttagctctgccattttctagccatgagttggaaaaattacttgactgtgtatcatttattcaacaaatatttcaacatttcttgaagatctatctactgctgggtactgtgttatacattacagatagccgcagtatgtaatgcacagtcccaggtttatctagtgcagtgcgagagacaattatcttagcccactttgtgttgctataaaggaatacctgaggctgggtaatttgttttaaaaatttggctcacggttctgcagacagtacaagaagcatggccatagcatctacttagcttctggtgaggtcctcaggctgcttccactcatggtggaaggcgaagggaagctagagtgtgcagatattccatggcaagagaggaagcaagagagagtcaggggaggtgtcaggctctttttaacaactagttctcaggtaactaagcaagaactcactcacccaccccagggaaggcattaatctattcctgagagacccactcccatgacctaaatttctcccattaggctgcacctcccaacaccatcaaactggggactgaatttcaacatgagctttgatggggacacatattcaaaccatagcaacaaccattaaaagtatcatcacggccgggcgcagcggctcactcctgtaaccccagcactttgggaggccgaggcaagcggatcacctgaagtcgggagttcgagaccagcctgaccaacatggagaaaccccgtctctcctaaatatacaaaattagccaggcgtggtggaacatgcctgtaatcccagctactcaggaggctgaggccggagaatcgtttgaactcaggaggcagaggttgcagtgagctgagatcgcaccattgcaccccagcctgggcaacaagagcgaaactccgtctcagaaaaaaaaaaaatcatcacgggggtgttaatttttacaaaaagagaggtacagcatgttgtagagtgtataacaatggacttaaccttacccagtgagtccaaaatgaagagatgacacttagctgaactgtgaaagacaagtaggactagtccaccaatggaatggtaagagttacttggcatctccatttggctgcctaacaggcatctcaacttatcatggtcacactgaactcttgatcttccccctctccgccctctccacttggcccaccttctcctcctgaggtgttcaccatctcaggaatagcaacttcatcctattcattcctcaggccaaaaccttcagaatcatccttaatgtctccctttctgtcacaccccatatgcagtgccagctttacctgaagctaatgaagttttagcctcaggaaccctcatattccaaggccctggaaaggcccctaggaatgtgttcacattgtcatatatttttgtaaaatttgcgacagtaagatattcttactgcagtcagttaagaccactgtatctttccattccaaatttccttccatcatgtttccccttgtattaggtgctgttggagtgaccaagaacatttttgggatcctgcttaggtgaagttgagttagggatacatttagctgggctttggcaagatacatttatgtggtttgcagtcacttccttgtgtactgcatactgctgtcccaataaaaggctggcttcctggaacaccccttacagcccatgtgctgactcacctggtatagtgacagaacagtagagaaccagaagtcataaagtcatattgtgatatgaatctgtcctatggtacttgacactggaagcatagaggtagtagaggtgacacaaggtttgaaatgtacacagccagaagctagactgtgggaaatccttctaaaacatagacttgtatgcagaagatttggctcttactgatgcctagattaaaatgggatttctcatgccaaggcaggcggatcacttgagctcaggtgttcgagaccagcttgagcaacatggcaaaaccccgtctctacaaaaaaatataaaaattagccaggcttggtggcgtgaacctgtattgtagtcccaactggttgagaggctgaggtgggaggatcgcttgagcctgggaggtcgaggctgcagtgagctgtgattgtgccactgcactccagcctgggcaacagagcaagaccctgtctccaaaaaagggatttattaactgttaagaatatactggacaatgcagcatacacaattataagtgcagcatactctgtttttttttttttttttgatgggagtatcattaaatagaattgttcataggacacagacctgtagcagtactacaagcaatgagtatgtgtgtgaagtcacgggttttatgaatcccagcatatcaaatcacgcattagatagagtatctgactcatcttttcctgacaaagtctacctgattggcataatttttctcattttatatacatactcacatttgtactttattttgtatgttttttaaacaaggccccacaaactaggtaagtttcagatcctatgtataggatatggccctgctcacactttatatctaaccagcaagtccagatggctatactgtcaaaatatgtccataatccaaccccttctcaccacctcgaatgctactactctggcccaagccaccatcatctctcacttgggtcactgtaatatcctcctgaacagtcttcccacttcctcttcccccacccacatcttctcttgagtctattctcaacattgcatagagggatgttggaataaatttaattagattatatgactattctgctcaaacccctccaatagcttcacaattcactcggagaaaaaagccaaactccataaagtggcctcccagccccttcacagtctaggctccagctgtctcttcagtaccatctcttactgtgcttgtccttgcttactccacttcagccataccatcttctttgccattcctccaacacagcatgcaagagtccccctcacaagtttgcaatgacgacttcctctccctagaatgtttttccctcagatatccacatggcttgttctctcaccttcttcaagtctttgcttaactatcaccctctcaaggaggcttacgttgaccttgccattgaaaatttcaccaacccaccctcttctgtactgtagatcctgcttaccttgctctctaccttttcttttttccatagtacttatcaccttctaaaataccatgcggtttacttaattattgccttcattaatttttctctctctcctctggctagaatgcaagctccacaagcataagaatctttattttgttcagtgctatatccccaatacttagaacagtgcccagcacctggtaggcactcaataaatatttgttgagtgaataaatagatgaataaagagttgtccagaaagagggaagagcatgtgcaaagatccagggatgagtgtttgacttattcaagaaacttaaagaatcctcaagtagaaagatcaaaaatgagagtggctcaagctgagtctggcaagacaggcagaaacaagaggatgaagggctctgtagaccggaataaagatactgaactttagagcaaagaaaatccatcaaggagttataaacaagggagtggtgtgatcgtagtttggagaggtcattggcagttgtgtaggaaacagattgggggtgggcggactggaggcaaagagaccagttaggaggctagaagagtagtccaggcaagagtatacaatgtcagaccagtttgggtggggacagtggatatggagagaaattgaaaaataataaaagtattaaggaagtgaaataaaaaagctctgaatatgaaccaaaggaagaaggggttttgataagaaagggatgataatctgtgctaactgctgctgtaaggttaagagaataaagactgaaaattgtctattgggatttagtgacagggaaataattggtgatcttgtcaagagcatttgccacaaaatggagatggtgaaagtcaatctggagtgtaatgccaagtgagtgagatctgaggacatggaggccactcctaatatctgcaaagcacctgacacctagtaggctctcagtaggtgccactttcctctctcccttctctgtattatgatgttgcagaactgtgacagtattgctaattaaacaaactccaagtaaagaaaacatgttaacatattaaaataataccatatgtagttaaatatttactatttctttggcatcaaatttcttaaggtaaaatattaaattcaaatattactgagggaaacagctggtactgaatattcaagctcccagaggaccacgttaatgaatcatttaaaaaactggacagcttcacatttaatctgttcaaggaatagaaacacagtcttttctcaattattgtcttatgagatgaatataaatttctgattagtctgttcccaaaatggaaatggccttttgacattatagtaataaatgtttattataaaaaattcaggcattaacttagtatataaagaagaaacagggtacagagtttcaatgttgcaagacaagaactgttctgtgggatgcatggaggtgatggctatactacagtgtgaatatacttgatgccagcaaactgtacatttacaaattgttaaaatgataaattttatgctatgtatattttaccacac[141 bp omitted]tgaaaccccatctctgctaaaaatacaaaattagctcagcgtggtggcacacgcctgtaatcccagctactcgtgaggcacgagaattgtttgaacctgggaagcggaggttgcagtgagccgagattgcgccattgcactccaacctgggtgacaagggctaaactctcaaaaaaaaggagaaggagaaggagaagaagaccctctaatcccattgcttaaatgggcatataggatttgtccttccttcattcattcagcagatatttattggatgcctgctatgtgccaagcacatgtctagatgctctggatacattagtgaacagaataatgtcctctcccttgcggaacttacttttaatgggggacaaagaaaatatataaatatacagggaagtatgtattatatcagatgtgataagtgatatagagaaaaataaggcagagaagggagataatgaatgatggggaggctgtaattttatattaggaaggtctcactgataaggtgacatttgagcagagacctgaaagaactgagggggtaagtcatgcagatatctgaaagaagagcgttccaggtagggggaatagccaatgccaatgctccaagatagaagtatgtttactccattccaaggagactagaatggagcaggttaagagagaggagcaggaaaggaagtcagagagatttgtgggagcacaggtcacataggtctctgaagggcacaaaaaaaggactttggattttactctgagtgacgatggaaaccactggagagttttgagtagaggaggaaccagataggacttggctttaaaataatcgctctggctattctgttcacattagactacaagaggacaagggaagaagcaagaagaaaaattaggaggctattgcaataatccaggcagaaaatgagggtggctgagaccagagtggtgggagtgaagatggtgagaagtactcagattctgtacagatattgaaggtagagccaacagtatttgctaaaagactgcatataaggaggatagatctaggcttgtgtggcctaacatacaatttggggggttctctcttaagaagaacaatacaaaattaggtacaaaagtgaatatttctttaaactgagaaaagaaatcacaatatattacaaatttataaaagcttacaaatactacaaacatcagaaaatctagaaaaataatttaatattaacttcctgacacactccctataactttctcatattgtaggttgcataccatttgtttccctgcccatatgatgattttataacattttctataaaaagaatagaaagataactttgtttttcctttaacatgattaaccaaaatttgtattttattgatacttctattttgttttaataaagtttttaattgccattgtaataataataagacaagttttgacaagctagtcttctttctttcagtttacatatttggctttcttccttcctatcatatttaaatttaggttcatcaaaaatctgaagaacaatacaaaattcatctgaaaataaggcatttataagaacaattgcagtgtattgaaaaatggacactgcattgtattgagttatgtaattatataatcaaatcacttttaatactgcatacattgagttactgattaatatgtttaggctttttgtgattggaacacttgtttcttcaggttattttcctgtgttcgtgacaattgcatatgccatttcatctgaaactgccagtcttcatcagaacaagatgagtcagatacactaaaacatgatccaatatgttaaaatgcataaaacatgcaaattcatacatagacaaaaatcatgatttataatactgctacaggcttatgctctgaaaacaaagcatttctgataaattctatttcacaagatttcctggaaaacagtatggcagttcctcagaaaatagaattaccatgtgatccaacaatcttacttctggatatttatccaaaagaattaaaattggggtctcaaagagatattacctctcccattttgactgcagcattattcacaatagccaagatgtggaaacaacctaaatgtccatcagtagatgaatggataaaaaaaatgtgatatatacatgcaaaggaatattaaccaaccttaaaaagaaggaaatcctgccatatgtgacaacatggatgaacctgtagggcattatgctaaaggaaataagccaggcagagaagcaaaactactgcgtgattccacttatatgtggtatctaaaattaccaaacttggctgggcatggtggctcatacctgtagcactttgggaggctgaggcaggaggattgcttcagcctaggagttcaagaccatcatgggggacatagtgagaccccatctctacaaaaaaagaaaaaaaaatctgagcatggtggcatacacctgtagtcccagctactcaggaggctgaggcaggaggatcccttaagcccgggagttcgaggctacagtaagctaggactgcaccattgcactctagcctgagtgacagagtgagaccctgtctctaataaaataaaatagttaaactcacagaagcagagttgaatggtggttgccaggggcttatgggaaagggaagtggggagttgttcaacaggtatgaagtttcagttcttcaggatgaagattttctagagctctgctgcaaaacattgtccctccagctagcaatactgtattgtttagtttaaaatatattaagagggtagatcttatgttaagtgttattaccacaataaaaaccatatgttatgcttatagttacacatgttgcattattgagtatattagtgacagaagaaaactcccattccgactaggcggaactgacttctccatatatagttttacatgtccagtgaataattttccacagactagtttctggctctgtacattccaaatctatttctcctcagctacacatattcccaatgctgggtgctataggaggcggtagtatttgagatatgatctttggccctgcaccactagccagcatagtaaggtaattgaggtgagagtatttctggaagccactcctatgctgagatggttaacagtggtatagaggtgactgccagccatggaaatatatctgatcaaatcaaaaataaatgtaaacccaattcaatttcccctctgcatgatcccaacaatgttcacagccaccccaatgccaatcccgccatgaaggaagagtgatacaggggaagtcagagtgaagagacagctgtcttaactgattgtaattaaaatattttacttttgcaaattttacaaaagcacatgactgtgttaccccaccgtaaggagccttgtgtctcgtaaggggctcctgcaagtgagcggctctgatgcttaagcttcattagcttcacagtaaatttggtactagatgtggagtgtgtgagagagaggagtcaaggatgatgccaaggtttttggtctgagcaactgggtgagtgaagttgtcatttcctgagatgtagaagactaacagaagataagttatggggatgaacatctgaagattcagtttggaacaggaaaagtagtttaagatgtctataacacagctaagccatgtcaagtaggcagttggatgtatgaatctggagttcaggagagaggacttgctgaagaagtaaattaggcagacagcagcacatgggttatatttgaagccatgagattagataggagcaaggagagtgagagaaaataggtggaccaagaccaagcccttgggaaattctaatgttggagaagttggggaaaagaagagggattaataaaagagacaaagaaaggaaccaatgtggtcaaaagaaaccaggacagcgtgaggtcctggaagccaactgaaaaagtgtttcaaagtcggagtgatcaactatttcaagtaatgttaggactgacagttgaacattagattttgcatcaatggtaatggagaagttgcccagaggtggttggagtgagtcaaagagagtggacagaataaacaacctacagaatgggagaaaatatttgcaaactatatatccaacaaaggactaatatccagaatccacaaggaactcaaatcagcaagaaaaagcaaataatcccattaaaaagtgggcaagtgacataaacagacacttctcaaaagaagatacacaaatgtcccacaggtatatcaaaaaatgttcaacatcactaatcatcagggagatgcaaattaaaaccacagtgagataccatcttaccccagccagaatggccattattaaaaagtcaaaaaacaatagatgttggtaaggatgcagtgataagggaacacttttacactgctggtgggaatgtgaattagtacaacctctatggaaaatagtatggagatttctcaaagaactaaaagtagctctaccattcgatccagcaatcccactacttggtatctacccaacaaaaaacaagtcattatattaaaaagacacttgcacacatgtgtttatcacagcattattcacaattgcaaaaatgtggaatcaacctaagtgcccatcaactgatgagtgaataaagaaaatgttgtctagtcacaatagcaaagacatggaatccacctaaatgcccatcaatgatagactggataaagaaaatgtggtacatatacaccatggaatactatgcggccataaaaatggaataagatcatgtcctctgcagggacatggatggaactggaggccattatcctaacacaggaaaagaaaaccaaataccacaaattctcacttataagtgggagctaaatgatgagaacacatggacacatagaggggaatggcatacacaggggcctattggaggatgaagggtaggaggaagaagaggatcaggaaaaataactaatgggtactaggcttaatatctgggtgatgaaataatttgcacaataaactcctataacacaagtttatctgtgtaacaaatttgcacatgtacccctgaacttaaaataatttttttaaaaataaataaaatgtggcatatatacaccatggagtacaaactactcagccatcaaaaaagaacaaaataatgtcttttgcagcaacttggatgaaactggaggccattatcctaagtgaagtaactcaggaatgggaaaccaaaaaccacatgttctcccttataagtgggagctaagctatgggtatgcaaaggcatacagggtggtataatggacactggagactcagaaagggaggagggtgggagaggataaaggaggaaaaaaattacctattaggtacaatgtacactatttgggtgacaggtacactgaaaaaccaaacttcactgctatacaattcatccatacagcccaaaaccacttataccccctgtgttagatcattcttgcattgctataaagaaatacctgagactgggtaatttataaagaaaggaggtttaatttggctcatggttctgcaggctgtacaggcatggcaccaacatctgctcagctcctggtgagggcttcagggagcttccaatcataggagaaggtgaagaggagccagcatatcacatggtgagaacaagagcaagagagagagggtggagaggtgctaatgttggagacatttaaacaaccagatcttacataaactcagagcgagagctcacttatcacctagaggatggcaccaaagccattcatgaggcatccacccccatgatccaacacctcccaccaggacctatctccaacactggggattataattcaaaatgagattgggaagagacaaatatctaaaccatatcaacccctaaaactattgaaatgaaagaaagatagaaataatctaaagttaggttgtaattatggttgcatagctctataaatatactaaaaagcttggaatcatatagtaaaaacatgagataattattttatataaaatataccccaggtaaagcctttttagaaataaatgtcaaaaaataccagagacagtgatcatactttgtggcttggaacttgcttttctcagtaatagttcttgggatttttttcctatcagtgcatatagatctacttcattaattttaaaaattgtttagtgtaagcggtaccataattatttacccaattccctttgatggacattttggtagttatctccttggcaatcataaataatgctgcaattaatatctttgaacatatttttatgcatgtgcaaaatacagatctctgatctctggaattgctaaataacaagtatgcacattttgagttttgacacattaccaaattgcactcaattgacttttctcatcagtaatatttcagaatgcccttttgacacaccattttaagcactagatactaataatcttttaatctttgccaccccggtaggtttgtaaaaatagcaatatgattttaatttgcatgactttgatcaccagtgaagcagaacacattttaatctttatttccatttatatttcttactttgtatcacaactgggtcctttccaattttttctatttaagcttgtatctttttatgttaatcaattagttagaatcatctcatataggctgcaaatatttttttctaaatatattgtttgaatttcaacattatttatggtattttaatagagttttaaaatgtggtctatgctttcattcttttcttttaatggtttctgcctccagcatcacatctgattgtttttttttttaacaaaagccagagaaataggttttcagattattaacccaaagcttaaagagagcacgttcccttttcatagctaatcaggtatctgcaatggaaacaaaatttcccctccccattcccaactttaatcaaaatgtttttctccttatgttactgacaaaaaaaaaagccactgcctaattgagacttctgtgtattcaattaatgcttctgtgcatttggcctgacaacgtccaggggctaatgggaccatgtgctatctttaacaaagatgagagtacaaacatgagtaagacagcctattatgggctttctggggccttttaaaaatattacattttcagcatgtgaattacaccaaatggtggcaacacaggtttctggggtttaatgcatttcagttcattccatttataaagcaaaattgaaataaagtaattctattccaaaatatgttttaatcgtgagtttttgaaagctctttaggtaagatgtttttgccttgcatgatttagaaaattaactgggtttccacagtatttgaatactgcaagttgaacttactttcaatctaaaagcaggcagaagagaattttgatgtaaactgaattattcgagtaattttcttaatgattaagaagtcaactcaaaaaaacaaatgctagccactgcctatagaataaagagttatcaatccttgtttttccaaagtagtccatatgttttagaggtaaattttgaagtaaatttgaagtaaatgtccaaagtaagaaaaataaaatcgaacattcagacttcaattactgcaaaaaagatttacaaaaatctttcagatcacaagaaattgttaaaacaacagaacccaaaaacagaggagaaaggaaaaagtatgggttgtgaggttaattccagcaggtctagaattagccctagttgttttattgaagttctggcatgacactgacctcctatcaagacacaaaacatactggttaatggtgttgttttgtagccatgagtcttcagattcatggtggtttgtccgagcttgtcgacattatgtattggtaacagtgagactgattatttgtacctggtctcagtgtgacacctgtccctccctcaaagggctctactgttaaggctaaaatatgcctgtgtgactgtcaaaaaattgtttaaaacccatctgagagtccattttggactccctggttctgaggtgttctgtgcacatgtcagtggttcctggtccaagtgataaagtgcatcctgctgtcacggctcttagagaggaggacaataggatcctgtacctgaccactccagacccctggctgtatccttttcctgtagtaaactatatacttgagagtaatgccatttgagtcctctaagtctcctttagcaatggaaccctgttcacttgccatagttaatgcagcatgaaaaagtcatccaggagagtggaagagattattagtgggcatacacattgttcaaaaatagtgctgaaaaaaatggtgctgggacaaatagtgtagtagatgtgtctgcccaggtaacagtgattcttcccagagaacttctatcttctatcttctcctttccaattcataaggtttcaggagtgggtccacaacagccatgtacacattaagtgacccatgttccctagccaaagctagttggatcagaggtgaacccctgacccaagctagactgatcagagtctcttccagtctgaagggttggcatctttaagtgaggaaacctaaaagctcacgtgttgagctttggtatacacagcttccaccaacaggaccaagtagccgagaaagcccagccacagagatgaatgaagccaaggctcagagggcagcagagctgaggaatggcaacaagctactctttgcattcctgacaccatttccttctctgattccagccgtttgggagattaagctccatccaagatctgggttccagagaaatactccatattcttataataaattccttttttttcccccatcaagctagcttgagttagcacctttactagcacctaaatatccttaactcactagccatgtagaaacatatagagctagatccctacctcactgcctgcccaaaaatacattccagatggaattaagatttcaatttcaaaataaaacaatatagggagtaaaatcaaatgtaggagaatttatttatttatttatttatttatttatttatttgagaccgggttatgtgttgcctaggctgatctcgaactcctggcctcaagcgagccactcacctcagcctcccaaagtgttggggttacagttgtgagccactgtgccccagccaggagaatatttttataatcttggaatctacaatcaaaaataaaaaagatttaatcatttgcctgtatgacatttgaatacttataaacagccaaaacacagcataaacaaagccaagaagcataaaaatagggaaagtatttgtaacaaatatacaaagcaaatgactagta[136 bp omitted]catggtgaaaccccatctctaccaaaaatacaaaaattagccaggcgtggtgggcaggtgcctgtaatcccagctactcgcgaggctgaggcaggagaattgcttgaagccgggaggtgaaggttgcagtgagccgagattgcaccatcgcactccagtctgagggacaagaatgagacttcgtctcaaaaaaaaataaataaataaaattaataagattaaaaaggcaggcaaatcgacaaaggatgaaaattgagaaatcatagaaggcaagttacaaattaccagcaaacatattatatgaaaagatgttcaacctgacacttatttaagaaatagaaatgaaaactacagattggcagatattaaaaagattaatagccctagtgatgacaaggttttagaaaaacatatactgtcttttaactattgttaaaaactttttggagtgtgatttggcaatatcaattaaaattttaaatacacaataacttttgacatcagtaattccactgctgggaatttatcctacagaaaatcacataatgtgcatgacactatataataaggttgtttattataaaatggtttataataaatttggacatacacaaatgtctatcacaaggcattgcattttttaaaaatctagcataaccacagagggtaataaactgcagcagtttaaaaatattgaggcagcattgtgtgtactgacatggaaagctacttgggaaatattttaagaaaaaagcaagttgcagatcacaggaatagcatgatcttatttttgaagacgtgagggagaccatgacctgataacagtggttacttgtgggcaacaggaaaccgggaggcagggaggggggcacagaaagctgataatttttaatgtatacagttctaagtgttctaaagcttctacaacagacatttattaattttgtaatgattttaaaataaaatatttttagaaacttcagacaaaaatggaaagatagctgggtgcggtggctcatgcctgtaatctcaacactttgggaggccgaggcaggtggatcgcctgaggtcaagagttcgagaccagcctggccaatgcggtgaaaccccatctccactaaaaatacaaaaattagccgggcatggtggcgcacgcctgtaatcccagctactcgggaggctgaggcaggagaattgcttgaacccgggaggcaggtggaggttgcagtgagccgagattgtaccattgcactccagcccgggtgacaaaagcaagaatctgtctcaacaacaacaacaacaaaataatacaatttaatttaaaaataaataaatgaataataagactcaacatcaaaataggtcaattctctttcatttaaattacaaatctaacatgatcccagtaaaactgcctattctggggactagagaagcttgtttgatgttcatatggaaaataagaaagaataaccagaaaaatgctgaaaaggaagaataatggggcaggaggaacttgtcttattaaagtatatacaataaatacggatagcaaggatgtttattaaccagtgtttatattagagaccaactgtagaccactaaaatacctaccaatataagactagttaaataaaatatgatatgtccatgttgtgcaatattatgcaattattgacaataatgtagatgtattgatgtggaaagatgctcatgacatattgctaaatacaataaagcaagttgcaaaacaataaatacaatgtaatcctatttatggaagaaaggcacatgtatatatgagcacacatacattacatgtatgtaaatacatgaaaagtagacagaaattatgcccactgaactggtaacagtggttaccttcaaggagaggactgggattcagggtatgggtggtgggagggagagtagtaaggattttgttctgtatgcttctataatgtttgaatcttttatgatgagaatgattcctgtatcacctgtatactttttaaaagacaaaaaatgtctgtaatcccagcactttgggaggctgaggcaggtggatcacttaaggtcaggagttcaagaccatcctgaccaacatggcgaaatcctgtctctactaaaaatacaaaaatgcatggtggtgcaacgcctgtaatcccagctattcaggaggctgaggcacaagaatcgcttgaacctgggaggtggaggttgaagtgagacgagatcgcaccattgcactccagcttgggtgacagagggaaactctgtctcaataaataaataaataaataaataaataacaaaaagagcagttaccacagtctgcttttctgtgaatgttgggacaaactggaccacaaacaaaagtttacattcagtcacacatttatttcttcattcattcaacaaatatttcctgctgagttctaggtacttggtactcactagcgattaacagacaatgctctgatccagggcagctcatccagctgggtgattgctgaagccagctgtcagatgaggtgactggaacacaggtgcagttgatgtggctctttagaagccacatagatcaattatgtatggttaatggctactaataaaataagaagttaatgcctgtcgcagtaatgtccaaaagtgacagacaatgcgacagaggcaaaaaatctaatgattttttaatccaatgatgcaaaaagagaaaagcaagcagcagtggaaaaatccaacatgtctcttgtaagacttttacctaaagcctttctcgatctctgaaccagccacggaatcaactctgccctcacttgtactttcttcgtgtgccaaagtggaaacctacccatggaaatttgcattttccttcttggaccatggcagactcagggagtggagggtggcagggcattgccagggcagctagtggggacctcaggaaccatagatttgtggctaaatacctgaaccctcccatcctggggaggactgggatttatgtggtcagagccagagtgtgaagcttctgccagaggcagcacagtctgccaaggacctgaaggtcaggtcaagccaaagccctcaggagaaagctggggtttgatcaccaggatgacctggtgcaggcctaaatccaaagagtccaagacaaggctcagactgagcaaagaatccaacactgcttgcctggccacatctccctgagctactgatttccctcctcatgttcccctttctgtcctctgaattcaagtcctggcactggctttcctgctacagccttggcccttctccacataagtatctggctttctgcctcaggctgcctgaggaaaagccctgagacaacctagcccctgggaccctgctacccaggagtcaagcccatggcctgcactcccggcccatttgtcctgttcccttcggtggcagagagaccagcaccctactcatgggcattagaatctcactatcagacccctggcaaggccctgtctgggcagctctcccgtttcaatattgctctctggttgcaacactttgcaggcatctttctcagtgtaaatccacaaattggtattctggattcgcaatcaaccagttacaaatttaggtagggcaatcccatccctagacctgaacacttttgggagagctgacaaagtttctgaatcctcaaatttgcaaaacagaccctccacccctgggaggacccgctcaaacagccaactggtttctttctttactacctcatcactgaaacaggcagagtccaagagacgattctgaaatatagaaccctgtctaggaaggcaggcttaaggagggcctccaggaagggactgtgagcaaagcataaagtgtatgcaggtgtatggtggtggggggggcaatggcaagaaggaggaataggaataagagcgtagttaagaacgtgggtgggagagggtgggtgctgagaattacttaatagatacaatgcacattatttgggtcatggatacactaaaagcctggatttcagactgtgcaatacatccacagaacaaaattgcatttgcacgttttagatttatacaataatttttaagacaaatgtaggctctgcctgtgtttgcatctcagtccagtttcctcatttgttaaacagaatcataatatctgaagtccagtttcctcatttgtaaaatgggatcataatagtatttaccactatattatgagaattaaatgagatagtaccacggaagacttagcacaatgtccagcacataagaagcactcagtatatgccacctgttcctagaggagagagtgaggccaaggaggttccaacgggaagaaaggagaaataaatgcagggagatgagaaagactcagataagctgcctaatttccacttttttccgagggccagctttgactattttaggtgttttaccagaaatgtatttgcatcatttgtaaatttccctgtcactaccaatttccacttccagctctgtccttttttatctgtgtgtgaccatgggtaaatctcctaatcactccatacctcagtttctccaaaaatacaagtaagtggttattgtagaaaactgttcctctccctctccctctccctccccctccccctccctctccgtctccgtctccctctccccacggtctccctctccctctctttccacagtctccctctgatgccgagccgaggctggactgtactgctgccatctcggctcactgcggcctccctgcctggttctcctgcctcggcctgccgagtgcctgcgattgcgggtgcacgccgccacgcctgactggttttcgtgtttttttggtggagacggggtttccctgtgttggccgggctggtctccagctcctggccgcgagtgatccgccagcctcggcctcccggggtgccgggattgcgggcagagtctcgttcactcggtgctcagtggtgcccaggctggagtgcagtggtgtgatctcggctcactacaacctccacctcccagccgcctgccttggcctcccagagtgccgagattgcagcctctgcccaaccgccaccccgtctgggaagtgaggagcgtctctgcctggccgcccatcgtctgggatgtgaggagcccctctgcctggctgcccagtctggaaagtgaggagcatctctgcccggccgccatcccgtctaggaaatgaggagcgtctctgcccggccgcccatcgtctgagatgtggggagcgcctctgccctgccgccccgtctgggatgtgaggagcgtctctgcccggcagccccgtctgagaagtgaggagaccctctgcctggcaaccgcccagtctgagaagtgaggagcccctctgcccggcagccgccccgtctgagaagtgaggagcccctctgcccagcagccaccctgtctgggaagtgaggagcgtctccgcccggcagccacccagtccgggagggagatgggggtcagccccagccaggccagccgccccgtccgggagggtggtgggggggtcagccccctgccaggccagctgccctgtccgggaggtgaggggcgcctcagcccggccgcccctactgggaagtgaggagcccctctgcccagccagccgccctgtccgggagggaggtgggggggtcagccccccgcccggccagccgccccgtccggaaggtgaggggcgcctctgcccggctgcccctactgggaagtgaggagcccctttgcctggccgccgccccgtctgggaggtgtacccaacagctcattgagagcgggccatgatgacaatggcggttttgtggaatggaagggcaggaaaggtgggggaaagattgagaaatcagatggttgccatgtctgtgtagaaagaggtagacatgggagacttttcattttgttctgtactgagaaaaattcttctgccttgggatcctgttgatctatgaccttacccccaaccctgtgctctctgaaacaagtgctgtgtccactcagggttgaatggattgagggcggtgcaagatgtgctttgttgaacagatgcttgaaggcagcatgctcgttgagagtcatcgccactccctaatctcaagtacccagggacacagacactgcggaaggccgcaaggtcctctgcctaggaaaaccagagacctttgttcacttgtttatctgctgaccttccctccactgttgtcctgtgaccctgccaagtccccctctgcgagaaacacccaagaatgatcaataaaaaagaaaaaaaaaaaaagaaaagaaaactgttaagatcattcctattccaacattcttattctatcttaaattcttgtctttttctttgtgaaagggttatgggttgaattatgtcctcagaaggatatattgaagtcttaagccccagtacctgtgttactggtggaaggtgtccaggttcttggcattttgaacaaagaattggacaaaatgcacaggtttgtcaaaggtcagatggctgtaggtgtgcagttttatttctgggttctctattctgttctgttaccagtggagggtgtccaggttcttggcattttgaacaaagaattggacaaaacgcacaaagcaaggaaagaatgaagcaaggaaagcagagatttattgaaaacgaaattacacaccacagggttggagtgggctgaagcagccgctcaagggccccgacacagaatcttcttcggtccaacactccctagaggtttcccattggccacttggtgttccccttatgtaaatgaagtggtggcccacagtcagaggctaaagtgaagttacaaattgcacttctatgcaaacaaagacttggcccgcaatcagaggctgaagttacaaagttacaatcctatgcaaaaagcaaccaatcagaggtattttcaatttcccatctgccccacagaaagggtggggatttgcaaagggagtagcctctggtccttttgttacttaggcgtggaaagttagggttttcctttccatttccttctaggaagtcagtgtgaatcagcctcaggttccctacctccagaccctattctcctacctcacctgtaaatgagaacttatttggaaataatcaaagatgtaatcaaattaagataggtcattagggtgggccctaatccaatatggctggtgtctttctaagagtagaagatgcacagagacacggggaagaagacagccatgtgatgacagaggcaacaattggagcgatccatctacaagccaaggaacacccatgattaccagaaaacaacagaagctagaaggagacaaggaaggattctcccctccaggtttcagaggggcaggctctgaaaacaccttgatttcagaattctagtgtccagaactgtgagaaaataaatttctgttattttaagccacccagtttgtactactttgttacagtagccctaggaaactaatccagaaagtgtccccaaaacatgtctatcttgtgctatcaaactgttgtttccaagagtcctaccttctttcatatctccatttctaattaaagaaagtttaaacacagcattctaaattcctgatttagcaatttcattaaatgataaaaattaatgcatgatataccagatattcggaaaacataaattgccagaagattgttatagcaacatccatactaattaacatgtcttaagaaaggccatgcgtgtttatcatctaattagaatcatacaatcaaaagaataaagagtacttccttgggggatataaaataaataaataactacaatattttcattaaagttggcaatgttcctttgaacctatttgaatgctagaaattgatgtataaattaaatggttttatagtttagatttgatatttagaagagatttagaccattagtgcaaattattttaaaatgtattttgtgtttgaaaaatactatgatgcttacaatgctatgtgaagaaaatgagctacaactcatttaaaatcgtgaataaaagggtgttttagagactgatgtccgtattcctatgagacctgaaaaattttccaaagttcagagtgtttgacaaaaaaatgcaccaattcctagatatggggtttgccaaattgtaacccacaggccaaatccatcccatcactggttttttgtacagcctacacgctaactacacacacacacacacacacacacacacacacacatatatatatatacacacacatatattaaacagttaaaaaaattgaaagaagaaaaatgttttgtgactcgtgaaatttacatgaaattcaaatttcagtgttaataaataaagttttatgggaacacatcctccctcactcattcatttacatattgtctatggctgtttgcatcactttcctgttgctgtataacaaattaccacaactttagtggcttacttaaaacacaaatttattatcttacagtttccactggtcagcagtcccggcaggactgggctgtttgttcagggtctcaccaggctgaaatcaaggtgttggccagggtggtagtctcatctgaggctcaaggtcctctttcaagctcacctagttggcagaatttaattctttgcagttgtagaactgggactcccattcttatgctggccaccagccaagggctaccttcagctcctagaggctggttacattccttgccacatggcccctccatcttcaaagtaagcaatagagagtctccctcacattcaacctctttaacattttgaatctctcttactaggaagagccctatcccttttaaaggctcacctgattaggcaaaacctaccatgcataatctccctattttaaggtcaactgatttgagacattaagtatgtctccaaaatcccttcacggcagcacctagattagtgtttgattaaataactgagataaagtttgtatgcatcaggggccaggaatctcagaagccatcttagaattctgcctaccacactgttgccatgctatgatgggaaacttcagtagttgcaacagagaccacatggccagcaaagcttaatatttggcccagagaccatacggccccaaattacttactatttggcccaaacagaacaagtttgctgatccctgtcccaaattaagctgagtttcaaacttgaaaactgcatgatctccgttcagcaaataaccctaaatctgggacagtgtaaacagaagggagaggccatgagagtgagacaatagtagcattaccaaactgtttcaacttttcaactcacatacacacacacacacacacacacacacacaaatacagatggtactgaactggtggtacttttttcttttcttttcttttcttttttttttggagatggaatcttgctctgtcacccaggctggagtgcagtggtgcaatctcagctcggctcactgcaacatccaccccctgggttcaagtgattttcctgcctcagcctcccgagtagctgggactacaggcgtgcaccaccacgcccagctaatttttgtatttttagtagagatggggtttc[131 bp omitted]cacacactaggggactaataaaatgataactcgcgtcataatattatcactgcccatctttgtcaaatcttaacatgtttgcttcttttaaaagtaataaaaattggccaggctcggtggctcatgcctgtaatcccagcactctgggagaccaaggtgggcagattacatgagtccaggagtttgagaccagcctggccaacatggtgaaatcctgtctctactaaaaatacaaaaaaattaactgggtgtggtggtgcatgcctgtaattccagctactcgggaggctgaggtgggagaatcacctaagcttaggaggtcgtggctgcagtgagcggagatggcaccactgcactccagcctgggtgacagagtgagactttgtctcaaataaaaaaaaaagtaataaaagccataacaatgtagcctcctctgatctcatgccactccctccaccttcagaggtaaacactatcccttccacctattcatctatccacagaaaacatattgcaatttgtcatcttttgaactttacagaaatcaaactatatagcacgtattctgcaatttccttctcttgcttagtgtgtttatgaaatttattcccatcaatgtgtatagctaaaatttgctcatttttactgacatacagcatcccattgtataagtataccatggtttatttttctattcaactggtggtgtacatttgggttacatgtagtcatttactattacaaacaatgctgctatgaacattcttgtgtggtctcctgactcagatatgaaaaagtatccctggctgggcgtggtggctcacacttgtaatcccaacactttgggaggccgaggcaggcagatcacctgaggtcaggagttccagaccagcctgaccaacatggtgaaacctgtctctactaaaaatacaaaaaattagccaggcatggtggtgcatgcctgtaatcccagctacttgggaggctgaggcaggagaatcacttgaatccaggaggctgaggttgcagtgagccgagatcgtgccactgcactccagtgtgggcgacagagagagactccgtctcagggaaaaaaaaaaaaaaaaagaaaaaacaaagaaagaaagaaaagaaaaagaaaaagtatctctagcatattatctgagagtagaatttctgggtcttagggtatgtgtatgtttatctttattagatattatcaaattcttggccgggtgcagtggctcacgcctgtaaacccaacactttgggaggctgaggcaggcagatcaagaggtcaggagatcgagaccatcctggccaacatggtgaaatcctgtctctactaaaaatacaaaaagaaattagccaggtgtggtggcacgtgcctgtagtcccagctactcaggaggctgaggcagaagaatcgcttgaacccaggaggcagaggctgcagtgagccgagatcacgccactgcactccagcctgtgcgacagagtgagactctgtcccaaaaaaaaaaaaaaaaaagaattgttctccaaaatctttgtgctaatttatactccaactaacagtaaacagttcccttttccctatgcccttaccaataattaataccatcaaacttttaatttttaccagtctcttgggtatgatgtggtggtttcattattgtttaattttgtattttcctgattacaaattatataaaatagctttccgtatttttactgtatcttcagatttcttcttctgtgatctgcctattcataagcccttgacaattttcctattgggccatttattggtttttaactaatctgtagtctttacatattctaatactaaccctttatcacttatattcatttattcattcattcaacaagtatttatttagtatatagtatatgccacacattatttgaggacagaaggatgtggcaagtcagcaaggcaaagtccctgatctcaaggagtttgaattctagtggggagacatgcaataaagagcaaatagatatataatatcaggtagtaataagtgctatgaagataaaacaaatggagaagatgaagtgacgatggttttattttcaatacggtggtcaaagaaggcctctttgaggaggtgacatttggacagacacattcattaattgaagaagagagtcagatgtatatttgaatgaagagtattcttccaggcagagaaaaatcaattgccaagggtctgggataaaagcaagcatgttgcaattatcttttcctagactgaagcttgttttttcattttgtttatgacttgtctttttgtacgcaagttttaaatttttaatgtagtataatttagccagattttactttatttatggcttatctagctgtattttgtttatgaaatccctccttactacaaggtcataaagatatttgccctgaccaggcgcggtggctcatgcctgtaatcctaacactttgggaggccaaggcgggtggatcacctgaggtcaggagttcgagaccagcctggccaacatggcgaaaccccgtctctaccaaaaatacaaaaattagccaggcgtggtggcaggcgcctagaatcccagctacctgggaggctaaggcaggagaatcgcttgaacacagggggcagaggttgcagtgagccaagatcatgccacttcactccagcctgggtgaaagagccaaactctgtctaaaaaaaaaaaaaagatattttcccatgctgtcttctaaaagtttgtaactacttatcacatttaggtcataaaaccactttgggccgggtgcggtggctcatgcctgtaatcccagcactttgggaggctgaggcaggtggatcatgaggtcaggagatcgagaccatcctgactaacacagtgaaaccccatctctactaaaaatacaaaaaattagccgggtatggtggcacgtgcctgtagtcccagctagtcaggaagctgaggcaggagaatcgctcaaacccaggaggcagaggttgcagtgagccgagatcacgccactgcactccagcctgggggacagagtgagactccatctcaaaaaaataataaaataaaataaaaccactttgagtttgtttttgtgtacaatgtggggttgagattttatttttttcaaaataataaccagtggttccaacaacatttattaaataaatcatttccacactgatcatgtattaagattttctttacacgtggtttctgggctctttgcattctgtcccactggtctatttttctctgtactgccttaattactacagcttataagaagtgctgccatcgggtagggtatattgtactgctttaatattgtcttgcttattcttggttctatttagaattttaattggaattgcattcaatctctaaatgaatttagggagactttgcatcattacattattaagtcttcctatacatgaacatattttatctattaacttagattttctttaatgttattcaataaagatttatacttttttgcatataggtcttgtacatcttttgttagatttattcctgggtgtctttcagtttttgtttctactgtaagctctaattggtacactattgtttttttatattgctcttatatcctaaaaccttgcttcaatattttacatatacttttgtattttctatgtggacagtcatgtcatctgcaaataataagctttgtttctccttttttgatccttactttttatttattttccttttcttactacactaattgggacctacagtacaaggttgaatagaagtgctagttttgctcctttgtatcattatggtgacgtaaattaatagttttcttaagttagatcactcttttattactgagataaacccaccttggtcataggtattttcaatgcatttttcattctgattgctagtattttgttttagattttggcatgtatgttcacaagtgaagttagcatgtaatttttctttctcataatatctttgcctggtttagcatagaggttatgctagccttataaaacgagttgggggagatttaatccaacagtttatatagtattgagattatctgttccttgtatatctgatagaattcacctatacaaccaactatctagcaggtaggtggtggttgtttgttggttgatagattttaaccactgcttcaatttagttcacaaacataagtctgttcagttttccccattttttcttgagtcaattttggtaaattttagctttatataaaattatccatttaagtgttcaaatttaatggcataaagatgttcataaagttatttttatttcaatgtcctatctactgttacttactttacacccatttatggtttggtttttttttttgttagatggagtctcactctgttacccaagctggagggcagtggcgcgatctcagctcactgcaacctccacctcccggtgcaagcgattctcctgcctcaggcttctgaggagctgggactacaggcatgcgccaccatgctcagctaatttttgtatttttagtagagatagggttcgctatgtcggccaggctggtctcgaacttctgacctcaggtgattcactcgccttagcctcccaaagtgctgggattacaggcatgagccactgcgcccggccccattttctttttttattcattgatggcactgaatttattgatgagtaggtgatttttttatggcttatctcatgatttattcagatctttaatgtctttcaatgaagctttacaagtttgttcttaaatgctttattttttgttgctcttgaaaatggcctttttaaaaaaaataatgtatttttgtgtatagtaaccctatttattctatttttaaaatcttttattttaagttcaggggtacatgtgtaggcttgttacataggtaaatgtgtgtcatgagggtttgctgtacagattatttcaccaccaggtattaagcctagtacccattagttacttttcctgatgctctccctcctcccaccctccaccctctgaaaggccccagtgtgtgaaagacccctctatgtgtccatgtgttctcatcatttagctcccacttataggtgaggacatgcagtatttggttttctgttcctgcattagtttgctaaggataatggcctccagctccatccatgtccctgcaaaggacatgctcttgttattttttatagctgcatagtattccatggtgtatatgtaccacattttctttatccagtctatcattgatgggcatttaggttgattccatgtctttgctattgtgaatagtgctgcaatgaacatacatgtgcatgtgtctttataacagactgatttatattcctttgggtatatacccagtaatgagattgctgggttgaatggtagttctacttttagctctttcaggaatcaccatactgctttctgcaatgggtgaactaatttacactcccaccaatagtgtacaagtgttcccttttctctgcaaccttgccagtgtctgcttttttttttttcctttttatcatagccatacagactggcttgagatggtacctcattgtggttttggtttgcatttctctaatgatcagtgatattgagcttttcttcatatgcttgttgttcatacgtatgtcttcttttgaaaaatgtctgttcatgtcctttacccactttttaatagggtcgtttagttttttcttgtaaatttgtttaagttccttatagatgctggatattagacctttgtcagatgcatagtttgcaaaaatgttctcccgttctgtaggttgtctgtttactctgttgatagtttcttttgctgtgcagaagttctttcatttaattagctctcctttgtcaatttttgcttgtgttgcaattgcttttggtgtctttgtcatgaaatctttccctgtgcctatgtcctgagtggtattgcctaggttgtcttccagggattttatagttttgggttttacatttaagtctttggttcatcttgagttaatttttgtatgatatggtataaggaagcggtttagtttcaatcttctgcatattgctagccagttattccagcagtatttattgaatagggaattctttcctcattgcttgtttttgtcaggtttgtcaaagatcagatggctgtaggtatgcagttttatttctgggttctctattctgttctgtcacgggtggagggtgtccaggttcttggcattttgaacaaagaattggacaaaacacacaaataaagcaaggaaagaatgaagcaaggaaagcagagattcattgaaaacgaaagtacactccacagtgtgggagtgggcggagcagtggctcaagggccctggatacagaatcttcttggggggagggagagcatcaggataaatagctaatgcatggggggcttaatatctagctaatgggttgatctgtgcagcaaaccactatggcacacatttacctatgtaacaaacctgtccgtcctgcacgtgtataccggaacttaaaataattttttttttgagatggagtcttgctctgttgcccaggctggagtgcagtggtatgatatcggctcactgcaacctccgcctcccaggttcaagcgattcttctgcctcagcctcccaagtagctgggactacagacacacgccaccacgcccagctaatttttgtatttttagtagagatggggtttcaccatattggtcaggctggtctcaaactcctgacctcaggtgatccacccgccttggcctcccaaagtgctggggttacaggcgtgagccaccgcacctggccataaatttttttttaatggaatgttcggacagagaccgagacatggggagaaagccacgtgaagaaagatgaaggcagagattgaagcaatgcatctacaagccaaggaatgccaaagattggctgcaaacccccagaagcaatgaaagaggcatagaaaagattctctctctcagccttcataagaaaccaaccttgctgaccccttgatttcagacttctgttccctagatctgtgagacaatacatttctgtgctcagtttgtgccactatgttataacagccttaggtaatgaatgcagcattagttaatgaagcattgacattgtccagcataatactggactagatgtccttaagggcacttctttacttctctaatacacaatttttaaaatggttcaattcaatgacagaagacaataaattgttggaaatatatttaattcatttattcattcaacaaatattcattgaacacactacatggcacagtagggaacaaaacagacaatcccctaccctggtggagcttacatgctaatgaaggagacagacattaacaaaaaaaagataaatacatagccacaaacttgttaagtgatattaagaaaatacagggtgtggccgggtgcagtggcttacacctgtaatcccagcagtttgggaggccgaagcgggcggatcacctgagatcaggagtttaagaccaggctagccaacatggtaaaatcttgtctctactaaaaacacaaaaattagccgggcgtggtggtgcacacctgtggtcccagctactctggaggctgaggcaggagaatcacttgaacctgggaggtggaggttgcagtgcaccgagaaagtgccattgcactccagcctaggtgacaagagtgaaactccatctcaaaaaaaaagaatgaaagaaagaaagaaagaaaagaaaagaaaagaaaagaaaagacagggtgctaggagagagtataagagagtattcatagacgtcctctctggagagacaatatttaaactggaaagttgaaggaagagaaggatctctatgtgaagacagggaagctcatttcaggcagaagaaactgcatgtgcaagggtcttgatgtagaaatatgttggcatgggtaaagaacagaagggctattagaacttgatatgcttgggaaataagagagagaaaaaaagtcaaagatgactaactgggaaactgagtgaatagtgggagctattgactgaggtgtggaagaatctaggaagaatgaaatgggtcagggtaggaagcaaaagttcagttttagacatgttaagttgggaatcagtaaatcttcaagtgggaaacaatatataagcttagagctcaggagaaaggcgtgggctggagatagaaatttgggagtcatcagtataggtggtatttatagccctggaactggaaaggattattagcaagggagtaagtggggctagagaagggagaagggccaaggactgagtcctggggcatcctgactcagagatttggcattgtcagatctgcattgtcatctgagactctcccttcccaactatactgcctttcccctttctatccgcaagtgtcaagtctgtgtcatggtctgaggcatttcctgcccaatcttgcttcctccccttttgtaattcacaagcagaccccaataaacttcttacactgctaattctgtctcagtatctgcttcccagaggacctgaactgacacaattggtaccaggattggtctgagaaagcaggagatgattggggttttggcactggatcacttaatgaaatgaaatgaggacttcttcccaagtagtatgtggaccatggatagtccctggtacaagatggtggcccaactgctaaaactgtcactggtagtaacttgggagagtgttctggtaaaaagaaaatgctctggcaggtgcaatgaagagtagagatgaataactttgcatagaaggactgtggacttggctggctgtcattaaggtgcacagacaccatatgaagggacaattaagtggctgagggcagttaactattgaaaactaagcatgaaggccagaggacctctttggtagctcataaagatgttcttatctcgttcagtgagacagcagaaaaacctagagatcaaactcagaatgaccaagcttcaaaggtgactgtatactcatccaagccaggtccacgatactcaagtcagcactccagttaggcaaacccaggatcgtggcaaacagcatgggaatgtctaagtgggtgctcccaaagattttgactcctcagactgctctgaacctttagagcctgcagcagtaactcatctctccctattaagggctggcatccaccccatcctttgtgggaagacagcacaaaggcctttcccttataaggcaccaagatctgcctccaccttttctcctggctataagaccagtaagtagggttaagtcagggtgtaagcctgccagggatgcgctgggcctggtaagaaaggaaaagatctataccccaaaggagttgtaagatctagccaacatatactaggagtcagagaggtcccacggactggatttagagtgtttgagcaatggggccagaacataagactaggtaagggagagtttattgatttgggggcactgtccaggaatacaggacttagcactgtggcaaggaccctaggagttggtgtaaactggcagtcagggtggcccctagaaccctggggaaagtgataactcacattgagtgagggtgaaatgcctaaattgccaggacagatggtaatgaaaggaactaagtagcgcaggaaggtgaatatgctggagtggttatataacctgaggcccgaagaccagccagagaattatgttgcacaggagggctcaggagatgcacgatttaccaacgccatgtggaatgccctggtgaaaggggtgccagcatcaccaagatgttccatggtgttgctcctctgcaggccaaggtggactacaggagaggcaatcacagagctgggcttgttaatggaagccaaagttataagggccgagtgactgtgtttaactgcccgaagtcagaaggctgcacttagaccacagtgattagcaatcagaggagcagccaaagacactccaggagttaagaggattaatagtgcatgttgtccctagaggcaaaataggtggattgccaacaagaatatcgtttaattacataatttttaagtggcaatagatgaggaggaggttgaaggtcaacactcctataaaaagccatgatctcctgcctagttcctggatctgagttatcagacttaggactcattgactgaagaggtggctaggtcccctggaagaagaaccctacacatcaccatggcaattataaaccatagtttgagtccttctcccaaaaggacctaagacttagatgactctacacgaaggacagacatttagagactactggaaattgatgtctagagacccaaaaagtttctctaacaaggaattccaggtaataagcaaggagacagaacacaaatttggatagaagatagtttaccaatataggagtactctcctggtatacacccggggaagggccctggaagacagcacaaacacaatgctaggatagatcctagaagcatgaaaaacatgttgtctgacactaagtgcagtagaaatgcctacattgccctggcagatagtgaagaaaggaatgagaaggctcagggaggtggacacgctggagtgcgtatgtcatgtgaggccagaagacccactggaggattctcttgtacagaaggactcagggaacatccagttcacccagtccataaggaatgtgctggagagagggatgccagcatatcaccagtaaattcaatgtggctctcctctgcaggccagagtggatgataggaggggcaatcacagagctgggctcataactagcaatggggatgacggggcctcttccatcctggaagggccagcaattcattctcacaggatggacattctttctgaatatggttttgcctttcctgcccacagaacctcatccagcaccaccatccaggggcttaaggagtgcctgatccacaccatggaatccaacacagcacagcatccaaacagggaatttatttcatagcaaaggaagtttgggagcgtgcctatgaccataggatcccctaggcatgcaacattccacaccattcataagtagctggcctgacagagtgatggaatggcaaggagcagctgaagcaccagctcagaagcaacactctgcaaagatgtggtagcatcctccaggatgcagtgtaagcactaaattagagacctctatatggcaccatctcgccaagaggaaaaatacatgggtgcaggaaccaaggagtgaaagcaggagaaccatcattctcaataacctactagtagcaagacattgtgctttcagtctccacaacctggggctctacagtgtaagaggtgagcacactcttgccaggggcgtagcaggagtcccattgaactatacgctacagctgccaccagagcattttggaggtcagagacatggggagtaaaaattagaaatactctgttataagatgcctgcactactcatgaagcagtatagtgttagttgaaggttgacttacattagttaaaaatgtacgttataggctgggcgtggtggctcatgtctgtaatcctgacactttgggaagctgaggcaggaggatagcttgagctcaggggtttgagaccagcctgggcaacatggtgaaaacttgtctctacaaaaaaatacaaaaattagccaggcagcatggcacgcatctgtagtcccggctacttgcagggctgaggtaggaggatcacttgagtccagaaggtcgaggctgcagtgagccgagattgagccactgcactccagcctgggtggcaaagtgagacccggtctcaaaaataaattaattaattaaaatgtatattataaagtatagggcaaccattgcaactgatacattaggagaggagataaaatggaatcatatgaaaagctcaatttaaaccagggaaggcagaaaaagacaatagggaaaaaacaaagaacaagagcaataaatagaaaacagttataaaaatggacacaaatacacacttagaagaaataagacctggttttcaatcatcagtagagtgattaa[145 bp omitted]gaaaccccatctctactaaaaatacaaaaattagctgggcgtggtggcatgcgcctgtagtcccagctactcgggaggctgagacaggagaattgcttgaacccaggaggcagaggttgcagtgagctgagatcgtgccactgcactccagcttggatgacagagcaagactctgtctcaaaaaagcaaaacaaaacaaaacaaaatagctagaggagaataattcaaatgttcctagttaaaagaaaagatttatgtttaagatgatggatattctaattaccctgatccgattatgtaaatgcatcaaattatcacatgtatcccaaaagtatgtacatctaatatgtatcaatttaaataaataaatatacgaaagaaaatagttataaagatggtagatattagtctgactatatcaaagtcactttaaatgtgaatggtctaaatgcaccaattaaaagacagagattgtcatagtggataagaaaataagctccaattacacactgtttataagaaatccacttttaatataaagacatagacatattaaaagtcaaaggtatggtggctcacacctgtaatcccagcactttgagagcctgaggcgggaggattgcttgagcccaggagtttgagaccagcctgggcaacatagtgagaccccatctctacaaaaaacttaaaaataaagtaaaaagatagccacagatatactaaaaaaacaaaaaacaaacaaacaaaaaaacaaaaaaacactgaacacaagaaagttggggtagttatatttctatcagataaagcaggtttcataacaaggaatgtcatcaagaataaaatggggatcattctgcgaccggcactccacaggtcagatggctgcaaagcagtggcggaggtgaccatagccacataatgtccatagttcgtttatccgtccatgccaaatggattatggggaaggtgactgggacaaaaatgcaaaagactgctaaagtgagagtgatcaggcttgttctggatccccatttattaaagtattataataagcaaaaaacgtactttgctcacaatgcccttcagcagtgcacaattggggatatcgtgcttctcaaagctttacctgttccacgaacaaagcatgtgaaacatgaactggctgagattgttttcaaagttggaaaactcgtagatcctgtgacaggaaaaccttgtgcaggaactacctatctggagagtccattgagttcggaaaccacccaggtaagcaaaaatctgaaagaactcaatatctcttcagcacagtgaaggaagaatggaagaagaagccaaagggaaagatttacatgtttgtttattttatggaaaaagaaatttttctaagtttcatcacaaactgtgtccaatttctcttgtggtatttatgaaatagctaaaagcaaatgaagtaaagggcatattatggtttttcacaaaggtttatggtcatgcttcaaattttcttttcagtgaacatactttcacgttacactaagtgtgtctagcggtctgttgcgttttgtaagctcactgttttagaaggttttgttttcgttttttgagacagggtctcgctttgtcgcccaggctggagtgcagtggtacaatcttggctcactgcagcctcgacttccctggctccagcaatctttccaccccagccttctgagtagctgggagcacaggagcgtgccactacacctggctaattttttgtaaattttgtagagacagggtctccctatgttgcccaggctgttcttgaactcttgggagtgaaatgctcacattggcctcccaaagtgctgggattacaggcctgacccattgtgcccagccagttttctttttttcattcaaaagaatcttgaatttaccttagaacctttattttgagggaagaaagcctttgaatataaacaaataaggccacattaagtgaatcttttggatgctatatattcaaaataaatattttatttttctgacttcaccagttccaaagggaaataatcaacatgcttatggtcagaattttttttgatcaagctgtattattaagaatgttgacatatagaaaataaaattttacaattctgaaaaagaaataaaataaaatggggcattatgggggtcaagtctcaagaaaacaatacaatcttaaaacgtgtatgccctaacaacaaagcatcaaaataaatgagacaaaaattgatagaactgtaagaataactagacacatctactattatcattggagatttcaacacccctctgtcagcaatggatagattaagcaggcagaaaatcagtacaaatatagaatggattgtggagaaggaagaaaatgaaacctagtggcagccctgagaccaactgcagcaagatgagctattgctcttcccactaacctcctcttctaagtcttccctcaggaagagaggttcacaggaactctgaacaagaactctgaagttaatccaagcaacacaaaggatggactgtggcaagcatggagctgcatagctcagagctcccatcaagaaagactttgccatggaactatgaggagtgaagttagcttacagcctcaggttgcaggaccttccaagactggctgcagtattcttgacaaaaccatgctttccctgggcagcctccagtcaataactaagcaaggtggcagttctagggcctggccacttctgcccaatgtgagactcttttaagaggcagtctttcctccagaactccccactgggttgagaccaagactttgtcatatttgcctcaaagtctaaggcaactctgccaaattctgtttccaccccttatcctttcacatgtgtcagatatgcattgtagtttgaatgcctttcctgcccaatcttgctctctgcccttttatctttcacaggtattagccacaatcaacatcctgcattcctaactccgtattagcatctgcttcctagaggacccaaatagacacaattagccacacaccactgccatccactttggggaaattcttcagaatacacttaatcaagcatttcaagagtctcttcattatgatcaaaatgttttcagcaagttcttcagtttaattcataactaggaaaatcagataatgaaaaccatttaataccacag[174 bp omitted]gtggcacgcgcctgtagtcccagctactcggaaggctgaggcaggagaatggcatgaacccgggaggcagaggttgcagtgagccgagatcgtgccactgcactccagcctgggggacagagtgtgacactcagtctcaaaaaaaaaaaaaaaaaggcatgtgtgctgtagctacagtttttacaatcactgcattcggtttatctggaaggatagaacactgatgaagcttgtcatacaagcatacatttgggctgcgtaaagttaatcttaatcatgcttatgatcattcagattaagggtttttgttccagaaagatacaagatttttcttgaaactcagtcaagtgatgaattttccttagggaagtcagtgacttccttgagcaaaagtagttatttatggtcattaccctaacctcataacaaagctggaaaaaaaaaactttaacataactggcaagcattaagtgcttctcataaccttcatgtgtagctcaggtagagagggctttcttgtggtcaacagtgtgtagctgtgttagttagtgctattgtttggatgtttgttcccccaaaactcatgtggaaatttgatccccagtgttggagatggggcctattaggagatgtttgggtaatggggcaaatctctcatgaatagattaatgccctagggagggaagtggtgagtgagttctcactctattacttctcatgagagctggttgttaaaaagagcctagtacctcccccttctctcccttgcttcctctcttgccatgtgatctctgcatacactggctcccctttgccttctaccatgagtggaagcaccctgaggcttttaccaagatgcccaacattccagcccgtggaaccatgagccaaacaaacctcttttctttattagctcagatatttctttttctttctttctttttttttttttttagacagcgtctcactctgtgacccaggctggagtgcagtggcacaatctcaactcactgcaaccactgcctcccagactcaagcaattcttgtgcctcagtctcccgagtagctgaaactacaggtgtgcactaccacatccagccaattttttgtatttttagtagagatggggttttgccacattggccaggctggtctttttgtttgtttgtttttgtttttgtttttgtttttgagacagagtctggctctgtcacccaggctggagtgcagtggcacgatcttggctcactgcaacctctgcctcctgggctcaggcgattctcgtgcctcagactcccaagtagctgggactacaggcacacaccaccataccttgctaattttttgtatttttagtagagatgaagtttcactatgctggccaggctggtctcgaactcctggcctcaagtgatctgcctgccttggcctcccaaagttctgggattacagacatgagccactgcgcccagccagatatttctgcataccgacacaaacagactgagacagtcaggtagactagaatctgctgtggtaacgaagaaaccctgaaatttcagtggcttaaccaaaggttgatttttcactcacacaaagtcctatgagatggttcctgtatgagcaactctccagggtggttttcctctgaggggtaaacccaaggatacaggttccttgcatcgtgttccaccatttcagagtcctttgcttcctgctgtacaagagcaaagagatttattaatagcatgaaaaatcatgaagggtattacatggtttaggcctagaagtggcagttatcaatcctacacatgttcccttgccaaaacaaaaccacatggtcccatttaggcaaaaagaaagcttggaaatgtaagggagcatgtggatattggtggatagtctctggcataatagactttgcttttgatataacagcttgaaaacatgaaacaagctctaacgttggatttacctaagctttcacactctttatagtttatcctgacacatcaccttcagtctaagttattcacataaagtcatcaataagcttaaatttcttctctatctcaattaattacatcaccatccacccatttgctcaagtgcaaaacttaaaatttatctgtgtttctgctacatagaaactggataaaagagccgggcatggtggctcacgcctgtaatcccactactttgggaggccgaggcggacagatcacctgaggtcaggagttcgagactagtctggccaacatggtaaaaccctgtctctatgaaaaatacaaaaattagctgggcatggtggcgggtccctgtaatcccagctactcgggaggctgagacaggagaatcgcttgaacccaggaggcagaggttgcagtgagccaagatcccaccagtacactccagcctgggcaacaagagcaaaactccatctcaagaaaaaaagaaactggataaaagaaagccaaagagccctgtgcaggagtgatcccagagcagcttctatgaatattacaattccacttggaaggaattcctaaagtgaagatggattggcagaattacctgtgaagttatgctcacaatgtcaggttcatttaaaaaaagaaaataaaatagaacgacctatgaagagtattttaatatttccctttgctctaaggctgtgttttatactaacttcttattgcagtgtgatagcccattaagacttccctaaagggaagagggttccctgaatatcctatgtgagtattcaggtctgcttaacagttatagttctcactgtcaattaataaactgacattttggttcatatatatctgtaacttatgagtagaatcattcattcattcatatatttaacaaatatttattgagtgcctagtaggctacagttttaaatgccaaaaatatagaagtataccaaacagataaaacctctgccctcacagagcttacatcttagtaggctaaagagagacagattttggcccagagtggtggctcacacctgtaatcccagcactttgggaggctgaggtgggcggatcacttgaggttaggagtttgagaccagtctggccaacatggtgaaaccccatctctactaaaaatacaaaaaattagccacatgtggtggtgcatgcctgtaatcccagctactcaggaagctgaggcaggagaattgcttgaacccaggaggcagaggttgcagtgagccaagatcgagccactgcactccagcctgggcaacagagcaggactctgtcaaaaaaaaaaaaaaaaagagagagagagagaggtttttttaagaaaaatatatagtgtgtcagatggatagtggtaaattctatagaaaacaagaaagcagggaagggggacagaatgtaccaaggtgggggttacaattttaaacagagtattcaggcctcactgggaagaagacatttgagcaaatctctgaaggaggtgaagaagcaaccattcagatggctatggaaaagcattccaggcagaagagacaccaagcgcagaggcctgaggtggggagtgcctggtttgtttatggatcagcagaaaggccagtgtgactgaagtagagtgaacacaggagagagtagtggcgaggagtcagagagataatgtgggggcagtggggggatgagggaaagattgtgtagggccttgcagagcagtattaggattttggatttttgagatgtagagtcattggagggttccaaacagt[133 bp omitted]atggtgaaaccctgtctctactaatacaaaaattagtcaggtgtggtgctgtgcacctgcagtcccagctactagggaggctgaggcacaagaattgcttgagcccgggagcagagtttgcagtgagccaggatcacaacactgcactccagcctgggtgacagagtaagactatgtctcaaaaaaaaaaaaaaaagtttccatttgccacgatggggaaggcaagggagggacagatttggtggggtagatcaggggtctcacttgagacactttatgattgagatgcatatgaaatatctaagtggagctactaaaggggcctctgaacatggtgtgtccggaattggtgggttcttgggtctcactgacttcaagattgaagccgcggaccctcgcggtgagtgctacagctcttaaggtggcgcgtctggagtttgttccttctgatgttcggatgtgttcagagtttcttcattctggtgggttcgtggtcttgctggctcagaagtgaagctgcagaccttcgcggtgagtgttacagctcttaaagaagcacgtctggagttgttcgttcctccggtgggcttgtggtctcgctggcttcaggagtgaagctgtagatcttcccagtgagtcttacagctcataaaagcagtgtggaccaaaagagtgagcagtagcaatagcaagatttactgcaaagaggaaaagaacaaagcttccacactatggaaagggacccacgtggcttgccactgctggctccagcagcctgcttttattcttttatctggccccacccacatcctgctgattggtagagccgagtggcctgttttgacagggcactgattggtgcattcacaatccctgagctagatacaaaggttctccacgtccccatcagattagttagacacagagtttcgacacacaggttctccaaggccccaccagagcagctagatacagagtgtcaattggtgcattcacaaaccttgagctaaacacagggtgctgattggtgtgtttacaaaccttgagctagatacagagtgctgattggtgtatttacaatccctgagctagacataaaggttctccaaggccccaccagagcagctagatacagagtgtccattggtgcactcataaaccttgagctaaacacagggtgctgattggtgtgtttacaaaccttgagctagatatagagtgccgattggtgtatttacaatccctgagctagacataaaggttttccaaggccccaccagagtagctagatacagagtgtccattggtgcattcacaaaccctgagctagacacagggtgctgattggagtgtttacaaaccttgagctagatacagagtgccgattggtgtatttacaatccctgagctagacataaagactctccacgtccccaccagactcaggagcccagctgggttcacctagtggatcccgcactgggcctgcaggtggagctgcctgccagtcccgcgccgtgcgctcgcattcctcggtccttgggtgatcgatgggactgggcgccatggagcagggggtggtgctcgtcggggaggctcaggcggcacaggagcccatggagtgggtgggaggctcaggcatggcgggttgcaggtcccgagccctgccccgcaggaaggcagctaaggctcggtgagaaatcgagcacagtgccagtgggctggcactgctgggggacccagtacaccctccgcagccactggcccgggtgctaagtctctcattgcccgggaccagcagggctggccggctgctcccagtgcggggccagccaagcccacgcccacctggaactccagctggcccgcaagtgccgcaggcagccccggttcccgctcgcgcctctccctccacacctctctgcaagctgagggagtgggctccagccttggccagcccagaaaggggctcccacagtgcagtggtgggctgaagggctcctcaagtgccgccaaagtgggagcccaggcagaggaggtgccgagagcaagcgagggctctgaggactgccagcaggctgtcacctctcaatgggagtccagagttcaggggagaagtccaaactagagatacagtagtcctctcttatctgtaggagatctgtcccaagatccctggtggacgccttaaaacatggatagtattgaacccaatatatatactgtttttttttcacctgataaccgagagagctactaagagaccaacaggcaggtatcatggacaacttgggtacaatggacagagggatgattcacatcccaggtaggacaaagcaagatttcatcacactactcagaatggtgcataatttaaaacttatgaattgtttatgtctggaatattccatttaatatttgcaaactgtagttgaccacaggtaactgaaactgaggaacatgaaacttcagatgagggaatactacagtatatatttgggagtcatcgggacatagatgacatttaaacccatgagactaaatgagatcagcatggaaatcggtttaaatggagaaaaagctcaaggagttagcctagagcactcgaatattttagaggtcatggagatgaggaagaaccaacaaaggagaccaagaaggagtggcggtagttatcaagagtcagccttctgagcctgctggctgcagggtatcctgataaagctgaatttctggatctgcagagctaagaaatcaacagcagggaccctcaccaaggtactgctgtctggagaagtctagctaagtagtcagtcagtgttttcctttgatatcttttaaatgcaacaaaatctgatgcaaattataggcaaaaacatcaggacggcaatattgtggtagatatggctagtctcttgtttggggacagacattaaacactacagccatgcatgccacactggcaggaggagctccaccttgtgaccctccaaccaggccctcaggccaaccttggagaacacccagcagagacactgaaaaccactcccagtgaggcaggagaatagggactggagttaaggaccctaaggccatttcatgctgacttcctagaactaaattgaaaggaaaaccctaactttccacgcctaagtaaccaaaggaccagagactactccctttccaaacccccaccttttctggatggcagatgggtaattgaaagtacctctcattggttgcaaaaagcaaaagagtgtaactttgcaaaggagtgtaactttgtaacttcactttagcctctgattgcttgcaccagtcagatgtttgcataggagtgtgacctttgtaacttcacttcgcctctgattgtgggccaccacttcatttacatggggtgaacatcaagtggccaatgggaactctctaggggttatttggacccaagaagattctgtatccggggatcttgagccgctgctctgccgctcccacacagtggagtgcactttcattttcaataaatccctgctttcattctttcattgcttcattctttccttgctttgctgtgcattttgtccaattatttgttcaaaacttcaagaatctggacagcttgcagtcaagaccttctactgataacaccaatgccccaatagcaaaaggctactggctcactgcaccccctttcattgatgctgccaaataccaactgacctagaagtaaaagaacactttacactccaactgctggaccttatcagcaggttaggttgagagagatttaagttaagcttagcactccaagtctatgatgggttaaatcccaaagcctcaaatctctcaagatattcttcccccatccctgctgtaattgaaaccttggctgtctgctgacccctttcaagtgcgagctgtttattttctcatcccccccacagctaaatgcctcagggagtgccaggaggtggagctcgagctctcgtcgctccccaagaccactttctgatctttgttcctcctccctcctgagaaatctttggttcttccttggctcatgctatccgcttgtatcatcctctcccattcctggtagcagtcttctataccttcccagtcactaccctcatttgtgaagaatttagttctgtactcacagtctctctgtcctctttgtcccagcttcccctgtcattctcagtgatttcaacattcacgtggccaataacccagcgtgcacacctcatgtttccttgatctgcccattgcaaataactactgccattttgggacatacttcacaacccagagcagcaagatggggccttgtatcttgaaggttcataaacttcaattaatttttttcattggtacaccagcacatggtttataaaagttgacaactctttagaacaggaaataggtaaaagtgtgtattgtttttattagaagttgggcctgtgcttcattctttctgttttgttttctgttaaactcaccgtgggtcagtgattacaaatgggattttattttatttttatttttcagagatgaggtcttgctgtgtcactcaggttggagagcatagctcactagggccttgaactcctgggatcaagggagtctcccacctcagcctccacaatagctaggactacaggtgcacaccaccacactcagctaatttttaaaattttttgtaaagacgacatctcactatgtggcccaggctggtctcaaattcctggcctcaagtgatcctcctgctttggcctcccaaagtgctgggatcataggctgagtcaccatgcccagcctataaataggatttttaaatgtcacagtagatgaagataaacccctaatgatccaaagatacatatgcacaaggtcattcatcacaacattgcttaaaattgcaaaatattggaaataatataaatgtccatacataggtttatagttgaataagctatggtacatccatacaatagaatactatgtggctgtaaaaaaaaaagtgagaaaactctctacaaactgaagtggagtgacttctaaaataaagttacagtgaaaaagcaaagtgccaaagatatgtctatagaatgctaccttttaggtagtaaataaaaggaagcattttcatacaaacatctgtacatgaatgttcacagcagcattattcataatagccaaaaaccagaatcagaccatcaacggatgaagggatgctatcatttgaatgtgtcccctccaaaataaaggtgttgccaatgtgatggcatcaagaggtggtgcctttaacaggtgattaagccattagggcttctccttcattaaagggaataaggcccttataaaagaggcttcatgtagcatttgattagtttgctattccaccttttgccatggggtggtgcagcaagaaagactcaccataccagatgccagcaccttggttatggactttccagcctccggatctgtaagcgatcaatttttgttctttataaattacccagtcttggccaggcacggtggctcacgcctataatcccagcactttgggaggctgaggcgggtggatcacgaggtcaggggttcgagaccagcctgaccaacatggtgaaaccctgtctctactaaaaatacaaaaaaattagctgggcgtggtggtgggtgcctgtaatctcagctactcaggaggctgaggcaggagaactgcttgaacccgggaggtggaggttgcagtgagccgagattgcaccactgcactccagcctgggcgacagagcaagactctgtctcaaaaaaataaataaataaataaataaattacccagtctcaggtattttgttgtagcagcacaaactaaaacaatggataaacaaattgtggtacatccatactatggaatactacccagcaatcaaaaggaagaaactattgatgaacacaacatggataaatctcaaaggtattgtgctgagtgggagaagccagtctcaaaaggtaacatgctatatgcttccatttatatgacattctcagaaggcaacatgatagagatagagaacaaatctgtggttgcccaggtgggggttggggaggccttgactacaaaagggcagcacatgagaagttgggaacagctctggatccttattgtggtagtggtcacaccagcctatacatgtgctcaaattcctaggactctacaccaaaatatgatgtgattatgctgcatatcaattacaaaaagtatagtggtggaatttgtggtaaaaatgttatgactttaatcgtaggtcttcagatagttattagagatgtatcactccaacacttggaccgtctattggtataaaaaaaaatactggccaggcacggtggctcacacctgtaatcccagcactttgggaggctgaggcgggcagatcacctgaggtcagaagtttgagaccagcctgaccaacatggagaaaccccgtctcactaaaaaaacaaaattatccaggtgtggtggtgcatgcctgtaatcccagctactcaggaggctgaggcaggagaatcacttgaacccaggaggcagaggttgcagtgagtcaagatcacaccactgcactccagcctgggcaacaagagcaaaactccgtctcaaaaaaaaaaaaaaaaaaataccagcagtgccaggcacagtggctcatgcctgtaatcccaacattttgggaggccaaggcaggaggaggattgcttgagcccaggagttcaagaccagcctgggcaacatagtgagacctcatctctacaaaaaaattttgaaaattagctgggcgtggtggtatatgcctgtagccctagctactgcagaggctgaggtgggggtatcacttaaacccaggagttggaggttgcagtgagttatgatcatgccactgcactcccgcctgggtgacacagcgagaccctgtctctgaaaacaaacaaacaaacaaaaaaaaaaacagcagcaaagaaactaaaagtatcatgcaactcccatgaaaaataactgaaatttggattaccatgacctggtgtattggtccattttcacactgctgataaagacatacctgagactgggcaacttagaaaagaaagaggtttagtggacttacaattccatgtggctggggaggcctcatgatcatgtcggagggcaaggaggagcaagtcacttcttacacagatggcagcaggcaaagagagagcttgtacagggaaactcccatttttaaaaccatcagatctcgtgagacttatccacctagaatggaaggacatttcatcatcacctaaagctaaacacaacaggccaaaggcaaaagctatggaaaccacattttataaggttgtactgaattgcaaaggttagacctactgaattcattgttcacacacttaccaaaactgctgccaaagacatagtgaaaatgatgactgggaacaaagcaagtgtatttgtcaaatatcacagttctttttaaaattacagatgtggctggaaacttaaaatagcaaatatccaacttctgaggaagttgatattatttgctgcaaattgatgagtctactgatcttgtgaatttagctaatattttggtatttatcatatttaacttaagccacttcatgaagacatcatgttctgccaatcttttgcaacttgtacaactgaagaagagatttccttctcttccttccttccttccttccttccctccttccttcctttcatctaactaatgattgctgggcactaatgtgccagccaccattgcaggtaacaaggacactgctgtgaacaagagacaagatcccttccctcatggatcttacattctggtaggtggaaacagacaataaaatgacaggaaagaaaaacagcagacagggataaatgctatacagagaattgaaatggggcaatgtggtagagtgaatgagggccctgtagatggggcagtcaggcaaagccctctgacaggaggtaacatttttttttttttgagacggaatcttgctctgtcacccaggctggagtgcagtggcacgatctcggctcactgcaagctccgcctcccaggttcacgccattctcctgcctcagcctcccgtgttgctgggactacaggcgcccgccaccatgcccggctaattttttgtgtttttagtagaggcggggtttcaccgtgttagccaggatggtctcgatctgacctcgtgatccgcccgccgcggcctcccaaagtgctgggattacaggcatgagccaccgcaaccggccgaggaggtaacatttaagttgagctctgaacgacaaaaagaaatcaactctgcaaactggggaaagaacattccaatcagaggaagcagctagagcagtggttctcaacaagaatagcaccacctcctaggaagcattttggaaatttgcggggaagagtaccacagtgattggggtattctgctggcatttactggagaaaggccagggaagctgcacatctgcaatgcgtaagacagtcctgcatccttcatggctctcaaagatcccatcagacattcatgtaggtggaaaacctgtttacaattatctgtgtcaagaacttaactttgctttactgctaaagacaaaacattttttgcacagtgtttttgtacatggcattttccaggatcgcaagtaccatgtaaatagaaggaaggttgtatcttgtttgtttctttcagaacttcatcaagagttgtttaacattaaaaaaaaaaaaaagttgccggccagctgcagcggctcatgccagcactttggaaggcccaggcgggtggatcacctgaggtcaggagttcaagaccagcctggccaacatggtgaaaacccatctctactaaaaatacaaaaattagccatttgccgggtgtggtggtgggcgcctataaccccagctactcaggaggctgaggcaggagaatcgctggaactcaggaggcagaggttgcagtaaaccgagatcgcgccactgcactccagcctgcacaacagagtgagactccatctaaaaaaaaaaaaaaaaaaaaaaaaaaaaagttgccaaggaaataaagatgtgtcattaaaaggaaaaaaatctcaccaatggcaaggcaatgtcacagaaaacactgcaccttcagagaaaattgatggagaagagaattttttaaattgatgatacatggccacggcaaaacaaaacaaaacaacaacaaaaaaaaaaaacaggagaaaaaggtaaacagtataaaaaggcacacagggttgggtgcggtggctcacgcctgtaatcctggcaccttgggaggccaaagggggcagatcacttgaggtcagtagtttgagaccagcctggccaacatggtgaaattccgtctgtactaaaaatacaaaaattagggccgggcacggtggctcatgcctgtaatcccagcactttgggaggccaaggcaggtggatcacgaggtcgggagatagagaccctcctggctaacacggtgaaaccccgtctttactaaaaatgcaaaaaaattagccaggtgcggtggcgggcgtctgtagtcccagctactctgaaggctgaggcaggacaatggcatgaacctgtgaggcggagcttgcagtgagccaagattgcgccactgcactccagcctgggtgacagagcaagactccgtctcaaaaaaaaaaaaaaaaaaaaattagattggtgaggtggtggctgcttgtagtcccagctactggggaggcatgagaattgcttgaacctgggaggcagaggttgcagtgagctgagatcgtgccactgtactccagcctgggcaacagagcgagactctgtctcaaaactaactaaataaatcaataaataataaaagaaaataaaagggcacacagtcaaaactcaatctcccttccacctctgttcccaagtctccaggtttccttccccaaagataacctgattatcagttttttgggtatccttccagaggaattatttcttttctgtttcaaaggaaggaaagaaggaaggtaagaaggagggaagagcggaaaggaggagaaagcaaccccatataaatatttattggtctgagcatgaaaaaaaaatatgaggaaaaacattcacacacgcaccaagctcttaaccgtggttacctcagggcatgggcaggggaacttaactttctttaatacacttctggactatttgtcttgttacaacaggtataaactactttataatttacaaatttcccaaaaagtaaaaaataaaagaaaattaggagagcaggaatcaatcaacattagtataaatataacaagataaattatattctaagaaatactagcaagttaaactaaagtaatgtactgagagatttcagttggtgagaagataaactgaaaaatgaaagctggagaatttaaaaaactgttagcatctcccaagccctgactggggcaacgagaggctgcctagggcttaactctcagctggccacctttctccttatattgcaacataacttctaagatttttttttttactcactgcctcttcctttttagttatcatacatttatttttagcatagcaccccaatttcacatcatgtacattttccaaagttggagcttgttaacctactatgctctccacagacttttcaacaagtgtgaaaaagaggcaataaggttggcttgagtatacaagtcacaatccaaatacaggatatcctcggagatttatttatgtttaggatgaatatacataaggtgcccaatgctaagcagatgaatgagactctggctgagtaaaatatgaacacctggttagcacatgatcatgaaaagacagaaggcatccaatatatagtttggtgttattcattttatgcttcagtgtacctgcagtgaaaaatatacattttactttctttttttttgagacggagtctcgctgtcacccaggctggagtgcagtggcgtgatctcggctcactgcaggctccgccctccagggttcacgccattctcctgcctcagcctcccaagtaggtgggactacaggcgcccgccac[138 bp omitted]cccggccatacattttactttcaaggttaaaataggccaggcgcggtggctcatgcctgtaatttcggcactttgggaggccgaggcaggtggatcatctgaggtcaggaattcgagaccagcctggccaacatggcgaaccccatctctactgaaaatacaaaaaaattagttgggtatggtggcacatgcctgtagtcccagctacttaggaggctgaggcaggagaatcgcttgaa[142 bp omitted]ttccagacccacgaacttcctgaaagagctttagaatcttgtcccgttatccaacaaagggctttaggaagtaccagtacccgaaggtttccttattgtaatccccaaattccaattcaagcccttttaaagtcggggtcctccggtcttcagagtcatacatctttctcaagcttcccccagccatcaaattagcttacaacaagacagaagaattcacaaaacatgaaaataagcattccccaattgttgagagcagagtatggcttctgcaactagaacaagttctcacagtcaaaaccttgtaatgtcatactcaagtgagattgacagtgaaaaataaaaaaggagaaaccctgcaatgccttttagaaaacgttcctatagcattgtgtgttagtaaatgtaaataactatacaagcctaaaaacaactatgtacccggaacatcttgctcacaccaacagactgctgacagttcctttccttgtaattattagtgacatggcttttttagaaaaaaaagagacagaaagaaattctgaaattctgaaatttttgaactgattaaagaatcctcggattctggccaagcctctcttagccattctttgcctctattgttctcttagcttacagaaccactgaaaatgtccctactggagttaactctgcagtcctagtagacatatagtgtagccgttagtggaaactgacataaaccgccctagatttcaaaccggtctctgctttgtaggtagctgtgtgagcctgagcaagtcctctctgtgtcttggtttcctctcctgtaaatgaatacctaatcagaactaacacatataaactgcttacccataccagtcattgttcattaatccttacaacaacccctaggaggaaaaaattataatctctgttttataaagcaactgacacacagagaggttgagtgacttccccaaggtcccacagctggtaagctgcagagccaagaatcttacacaggttcaagagtccagattcaagtccccacacccacacagcctctgtcaatgaggacatacgtacttagggccgttttgaggattacatgagaacgtctgtaaagcccagtacttgacaagtgcctgagagatagcaactgtggttgttagaattttttaccttctgcactgggaaaccatcaaggctttttggttaggcaggaaaaaaaaatgggttggaggcaagaggaggaggagggaagcgccaggggaggaagacagagaagtggcacgtgaaagggagaaaaggggcaaaccagaggagaggcagggaggggcggcgggggcgcactgaacatttaggaagcaagatgtctagcaggctgggccttgagagaacagtaactgtttcgcaactgaaagtcgctactcgagccttgccaactggggagactatgcccatgatatccgcggcctcggaccccggaccctccaggccctcgcgccccacccccgaccagcctcgggccaggctagggcgtagacggggcttcccgtccctcacgcgggcccgccccatgccgggcggggcctggggcccgccacctccgcccgtggccggagagccccaggcccgagccacgcggtcttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaagtaagagccgggcggggccggggaaccgggagaccggacgggggtggggtgggggagccgcggcccgacgccgccctgctgcctggactcggggccctggagtagggacggcccccttgtcgatcacctggggacccctcggggcggtgggccacctctatggcccccagagtgcagccccaatgcttttcacgttctcttggggttaccgccctgcaagatgcagttttgtggtccgcagccctggtccgagaggctttccggattggaccgggcgaggaggtggaatgcagcaaaggatttggaggaaaggaatgaaaagctctccagagagatgagtcctaaccatttccaccgtcctccaatttggaaacttttgcttaggctggcttaggaagagagagacccttttaaaggtgtttttgtctgtgtgacccaagccccgagaagaaagtgcttggtgtggggaaaggacccgatccatcgatacgaaaaggccgcagatttttgcccacacatctccccaacttaaatgaagcttgacttcaggctccgacagaggctgcagcttcccctccccaagctgagaacggccccctcagcctaccgcttcaccccactggcctcatttatttgggccttttccaccttctcccacatcaacagctgctccttaggaaaagatctaaaggtgtaaatgcagccttaaagcttccaccgagctcagaggtacctgcatttgaactggaaaccaagcctgaaagaatgaattggtagtgatggcatttcaggaagcagagatgtttctgtattggggggacggtccctgtgttcctcattcagtgggcacagtggcatctttgatatcgccttggctctgaattagacaaacagcccacatttgggagagtcggtcttgaccgcatagtttagtcttggcggctaatagtcaaaggattttgccttgacactgtcactcacctgggaggccagaggtggaaggctcacctggcagccgacaagccgaacggaatcatccttattacctaggcctctaggccagtactcattttgcctctgcctggaaatagagttcccttctcttcctctgcagagggactcatgggtgggaccatgacatttagttaaggccctttttcctccccacctctgcttgccctcatcaacatctggcctgcagtctgtaaacagttctcctctgagtcttaatgactcagtttctcccccacttcaccctcttctctacaaagtagtgtggaaatcttcctttggatgggataaaatatgtccagaggggtggggggcagaacttcaaaggctggtttaagtattgtggctcttctgctaagcacctagtatatgcacattagattttttaagctcctgcctcctgccctgtaaggtccataggacaggaagcattgtgcctgttttacagatgcagaattgggctcagagtgatgacacctcttgtcagtgaccgagctgagctccactacctggccttctgactccaaatctcatagtctttctgttacatcatgctgcctccctgcatccatttgacactaatttagtcaggctacattaagtccccactgtgtgcacgatgctgaggacaatgccaggatggaaggggcatggtccctgtgccccaggagcttacagagtaatagaagagtaagactaatatgtccatgaccataacacacaaggtagcatgtgattgtcatggataatgtgctctagaaatgtacccttctgatgagcgatgaggaggagaaaatgtgaagacttcatagaggagaaaaaaatttgagtttggcattgggagaatgaggagtctgctgggcagagatggagagaaagatactgcagttgatgtcagcaaatgcacagaggtgggaaggcaagcagcacaacaggaagtccaaccagaaaagcaggttggaatgagatattagagggttggattaagggatttggacttgacttggtatccaagggtagctgtgggaggtttttgtggggggtggggggaggtgtgttgtgattaaagcaattcaatggaaatgatcgtcacatcgtggcagagtaagatgactagagaggaggaagagtggagacagcagggccagttaggaacctgttgcactagtccacatagcagctgagggcaccggcaataggtgaccatgggagcagagaggaggagatgtctgggagaacgagaacagagacttacctgggctaggtttgctaggaattttttttcccctacaggattattttctttctgaaaactaaaaggaagtattttggtgaatggcaaggcatagttggaaagcaaagtgtttgattaatcgcgatgccatccttcctacatcaacatgatactcttgattcatcattatactgattcatttctactcttttctgaccatgaatttgcaaaacagttggctgggggcctgtgatcatgggtttgaacaaaacataaacatccagaatgttcagggaatggggtagttaagtgacttgtccacaaatgcaattaatggaagagctggaacttgaagccaagtcttctggctccttagttcaggtctctgtctaccattgcacagcagaaatatctgcttagttggattgacgatcaagagtccactcagtagtctgttgggagctaggttattgtaatgggtggctttcagatgtatcaaatagaagacccccccgccctggaacttcacaaccgcttgtctatcttatctaataaacgttagtttgggtccctgcagctctgaaattgttcataaccaacactatttctttattgaataagcacttcatgagcttatgtttggctgcactggctgccaacctgttaggttgaagtattggcagttataattacacatatccagggtgtgtgttgtatctgtgctggctgaaaggaaggggttgctgcaattcaccagtgtatccagtctcactggaaaaagcttctgtgcatgtatgtgtgggggtgggaggaagaacagaaaagggaacagtgccgccctagcaaatcaaaagtttaagatgcatggactgagatgacatcattggcggattatcagggttgcctgccctgactctgagattctaaggggaacaattgataggacttatctctgtatcagatgggagaagtctgcgaaaaaaggacttcctatggttcttctttttaattgtgtatatttgatattgagactctataaaagaaactgatataaaatacggctcctcttcctagttcatcaagtcattcagtgaattaagggcctgtttcctctccgcttgcccctaccagtcatttccttgtcagaagtgttgaactcccttaggctctatgctgaggactaacacagggtctgatacattgtagaccttcaataaatgagtagtgaattaactatgccctagaagtgaccaagtgggatggggaataagagtgggacaaggagaatgaatggtatttctttgggcatttcaaactccaccttctaggtggttccagcttgctgcagaccgcccctccagtcaaaaatttctttttttttttttggaagaagtattgctctgtcgcccaagttggagtgcagtgacgcaatctcggctcactgcaacctccacctcccgggttcaagcgattctcctgcctcagccttccgagtagctgggattacaggtgcacgccaccatgcctggctaatttttgtattttcagtagagacggggtttcactatgttg[132 bp omitted]tctgaggtccccctccaacttgactggccagggtatagaagagggaggaacgaggaagtgggcaggcaggcagtacaactgaggcagatagtctgttggtgaatgccacctgtttgagaaaaacctctgtcaaacttggtttttcctctgctctcacaccacaacaacaaccctcaacacagaagacttctgtgaccaaatgagtgtggggaaccccacactctgataaatggacaccaactaggtgtcctctgattcagttctgacactgtctacctggacataatgtcagaccaagccacaggttaagggcttggtccccaagaatggcccccaaccagacactagtcacaagtccaggcctccagaacttttttttttttttttttaagactgagtctcgctctgtgacccgggctggagtgcagtgcgtgatctcggctcactgcaacctctgcttcccggattcaaactattctgctgcctcagcctcctgagtaactgggattacaggcgcccgccaccatgcccagctaatttttgtaatttttttactaaagagaaggtttt[133 bp omitted]caagttggggttcccacgaccccctctttgggttcgattaatttgctagtgcggctcacagaactcagggaaatagttaatgtttaccagttaactacagaggataccacaaaggatacagagaagagatgggcagggtgaggtaaggggcagggggtgtggagcttccatgccctccctgggcacgccacccttcaggaacctccacatgttcagccatccagaaggttcccaaaccctgtcctctcgggtttttatggaagatttgttacagaggcatgattgacaaccatgtagaaatgtgactggatgaaaagcacatgatctaaacccagcaaggcctgtctgttcagacttttcttggcctctatgcagcgttcctttctctagggcagaggtgtccaatcttttggtttccctgggtcacactggaagaagaattgtcgggccacacataaaatacaataacactaacgatagctgatgagctaaaaaaaaaaaaattgcaaaaaaatctcataatgttttaagaaagtttgcaaattggtgttgggccacattcaaagccatcccgggccacatgcggcctgtgggctgtgggttggacaagtttgctctagggtatggggcaggaccctctctgggatgaggatcttttaacccacaatcagattagagtcctaccttgggcaggtaaaaggagggcaggagaaggtcaaagagagaaagattctgtttcctgagacctaaagtgccccaacattataacaaggactagggaagttaggagccaggaaccatgggtgaaaaccaatgtatgtatcatagcaccacatcacctttacttccctgtatgtttaaaagcagctgattaactcaaatgactgtttcagttaatgcggctaaggtaggttgacaaaatgaagtcaagactcctacagcttgaagatgtttttaatcagtgagtgtttacttgaaagcaaaagagctagcctagaaccccttaaatgctttcacctgaatgcccactcttatttctcatgcagcagcccctggcctatgggcaactgaaagaacaggaaatgcacctcctcactggaggtttgaaggctaaggaactggggatgctctcattttaaaaagataggccgggcacagtggctcacacctgtaatcccggcactttgagaggctgaggcgggcagatcacttgagcccaggagtttgagaccaggctagccaacatggcgaaaccctatctctacaaaaaaaaaaaaaaaaaaaaaaaaaatagccaggcatggtggcgcacatctgtagtttcagctactcaggaggctgaggtgggaggatctcttgagcctgggaggtggatgttgcagtgagcccagatcatgccactgtacttctgcgtgggcgatagagtggccaccgcacccggcccagaactgggcactttgggaggccgagcggggtggatcacctgaggtcaggagttcgagaccagtctggccaacatggtgaaactccgtctctactaaaactacaaaaattagctgggcatggtggcgtgcgcctgttgtcccggctacttgtgaggctgaggcatgagaattgcttgaacctggggaacggaagttgaagtgagccgagatcgtgccactgcactccagcctggccaacaaagtgagactctgcctcaaaaaaaaaaaaacgtaattactgagatgctcgaagttatcatttgaagaaattttgttcctttttaagtttcaacagaactgaaagactgcactccagttggtatttaccaggtacttctgtgcatttacaccccacaggcaagccagtgttgacaattatgtagataaaagtagaaaatgctttaagtgggaaggacttgggatagatgtaaattaagaaagttaggcatctcttatagccaactagcatcatataaatatagaaaaatgtaaatgtattattcatgaatgcttatatagtactatagtaacttttcactttgtaaagtactttgaaatgctggaaaatatttcaagaactagtggagagaactctagcacaatccatagttgatttctctggcctttccccctattttctcccagatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtaagatggaccttttcaccttgtccaagaaaaggctatgttctctgaaattacaaatgtattgtatacctttgtgagccactaaatcagttttactgagatcaaggttatatggattcaacctacatagaggcaattagcttcattctattccatagccatacactccactcctaaactttggccagttacatccccgggaggggagtagaccagaaagtggaggtgactcagcaaactggtaagaatgcaattctaaccactctccatctgactgcagaaggagtattcagtgtacatacacattgatatgccatgagggcaactagggtagcaactgtgtcttctggggtctttgtaacctttgccagagctacacatttatggcccaattgcaaaatccagtagactttttccctttatctgaacttggttgcagcatttgataaggttgaccaccccttcttctggaaacttggcttccaggacccctccaagtcctgggtgtcttcccatctctctggcagctctttcttatctgacttatccggcccatctgggtcgtctgatactgccagcccctacatgttgctcttcccctgggctccttccttagctttctttttaccctcccctttagcttgcttctcatcctccaaaccctccctaggtggcctcatctatgctagtggcttaagcaagcgtcagtgtattctgtgacccttattctctacctctttagtaacaatggccaacttttggggggaagtacttaccatgttctgggtactgggccaaatgcattgcatgcgctttctcatgaggccttattttacagatgaggagatagatgcttcaggaagctaagtgacttgcccaagtccacatagatagaaagcaggagaaactagcaatagaactccagagccctctgttagcccctgactgacaccaattcccaatggtagtatgagtccctgctgttggacaccttcacctccatgctccctaggcacatcaaattcaagattaaccctgatgtcctcgttggtctcaaactagctcttcctcctgtgttccctaatgaatgagactaccttcctttcaccccgtggcccaagccagaaaaaaaagcctagggatcacttcaacttctcctctcactccacccccacttgaatcaccaagtcccgtcgatttgactcatcctctttcccacaggtccttacaactcagactctcagggtctcccacagactctggctcctacctgcttccactcttggtatctcctgccccagtcttccccgtgcactgctgcccggctgaggtgatctctccacgtgcaatttcatcgtttcacggccctcatttcactgctctccttaaaaagtattcagcgactcctgagctacaggagaaagcccaaattccttaggacattctagatccttcagacctggcccctgccagtttgtcctacctcatctcctgccatacctccacctgcattcatgctccagcccttcagaaaaacttggatttcctggaaataccactccctttatacatgctattccctttgcctttccactctgtcaaagtctgatgaactcctatttattcctcaagacccagttcaaaagttctctctttcatcaagtccctcctgactcccccaggcaaaattaatccctttgatccttgtgtacctaatgcatttcatatagcccccctgttgtggcacacatcaggggtgttatactgactttgccctggctgtctgttctcctcgatgatgagcatctccagaaattagcccgctcctctttcgattcccagcacctgacatagggcctggcacataacctaagctttccagacattttctgaatgaaggtaaatggaaggttggtgagccaattaaataaacattacatttttctaaagataagcaatttcacttgtattatcccctattttaaatttcattttgagggagaaatttagtccctctgtaaactaaagatggctcctaaaggttctggaagtttgtgaaagtgccacctactatattacttactcaccatctcagttcttagaaaggtgaggaagccacacagtgtagggtgcccactgggccatgatatgaccatgtcattcccaaaggtgaagtcaggtgacctccctcaccatcgagagtctctcactttccagttttcataaaatgtttccttctcagctagagatcagtccctcctgtcctccaaaacataatgaggtgctgcccactggctttttttacttgagtgattttttccccgaacattaaaaaaaagcttcaaacatctagaaaaattaaaagaaatctagagtatacatccatggaccatctagatgctacaattaacattttgctattcatccctccagccattcatcagtccatttttattttatttatttatttatttatttatttatttatttattttttgagacagaatcttgctctgtcacccaggctggagtgcagtggtgcaatctcggctcactgcaacgtctgcctcccaggttcaagcgattctcgtgcctcagcctcccaagtagctgagattacaggcacgcacctccacgcccagttactttttgtatttttagtagagatggagtttccgttttagtagagatggagtttagta[137 bp omitted]taacttgcaaatatcaatacacttcacccctaaacccttcaacatgtgtgtcattaactagagttcaatatttgtgtatggttcttttttttgagatggagtttctctcttgtcacccatgctggggtgccgtggtgcgatctcagctcactgcaacctctgcctcctgggttcaagtgattcttctgtctcagtctcccaagtagctgggattacaggtgcccaacgccacacccagttactttttgtatttttagtagagatggggtttcaccatgttggccaggctggtctcaaactcctgacctcaggtgatcctcccgccttggcctcccaaagtgctgggattacaggcatgagccaccacgcccagccgtatggttgttttttaaagtacaatttacatccagtaaagtggacaaacctttagtgaaccatttgatgcattttgacaaatgacacaacccctaccaaaatatagcacattatcgcactcaagaaagttccctcatgctccttgggttggagggattttagcaaccccagagcccctcctgttttctttccccggaatccccccaggaatttatgttctcaagccagtgttttcccaagacagcagcagcttctccctggccttgttttgcaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggtgaggagttatcagagtggggtagggggtggaatgctttgtagtgtttgtggtcgggtaataacagcaaagaacactgaccccaagtgatgccaggtttccaaggagcttctgactgctcataaatactgtgcaaacccccactctgtggcatttctgctgctaacctcagagctgttggcttgagccccggctgcctcctcattcccatcctctgttttttggtcttttaagaagcctccaggctaggggcggtgattcacgcctgtaatcccagcactttgggagggcggaggcgggtggatcacttgaggtcaggagtccaagaccagcctggccaacatggtgaaaccccgcctctactaaacaaacaaaaattagctgggcgtggtggcaggcgcctgtaatcccagccactcagaaggctgaggcaggaggatcacttgaacttgagaggcagaggttgcagtgagctgagatcgcgccattgcactccagcctgggtgacacagaaagactatgtctcaaaaaaaagaaagaaaaataagaaagaaagaaaaaaaagaagcctccagatgaggcttctcttttctttcctgacttcctgattatatcacttgtggctctccttcctccaagaccagcagagagtagaatatgaaatgcagcctgctaatgctccctgtccttgctgcctccacagcaaggatgccactcttggtttcctcactgtgccttacctcagtgaagcagactggataggaccaacataagctaggaactgtagctaacaagggtccagcatccctgactccctcgctgagga[132 bp omitted]agaaaccctgtctctactaaaaatacaaaattagctggttgtggtggcacatgcctgtaatcccagctactcgagaggctaaggcaggagaatcacttgaacccgggaggcagaggttgcagtgagccaagattgcaccattgcactccagcctgggcaacaagagcaaaactctgtctcaaaaaaaaaaaaaaaaaatgaggcggcatcttagtgagaccactgaggcaaaatcctagaatcagaagttccaaagtgagtaattgtcttagcctagaataagccaattttgatcaaagaaaaatcagactagttcaaataaggttgggtgggtaacagttatatctgtacagtgggggcaggcccagaatcctagcagggctgaggtgctgtatcttctcttagccctgctcaggcccttaaaattcaaaaatagctaatgcatgctggacttaatacccaggtgatgggttgataggtgcagcaaaccaccatggcacatgttcacctacgtaacaaacctgcacatcctgcacgtgtaccacagaactaaaaataaaaatttttaaaaaaattccacttccataggctaggctgtctccatggcctcttctgggcaaaccctgatttatacaagcaatatattcctgaagaactctatagaaattaatttggggtcagctgaatccaagtttaaatgagcagtcccagccaagtttggttttcccctgtgactctaacttgtcctcgcttgctcaatgtccctccccgctcccgctttccctctgtagtagtcccggctgccctgggccatcgcttacctcagcactaaacagcctgaaggtgcttatcaaagctgccactccactccctgaaacttcatctgtctgggttgcattcctttcctgtccttgtccaaacagataattgtcgcatcattgtaatggtagtataggtgcaaaatttttctattcgttggtaagaagtctttatatattaaagatattaaccctttgtcatacatttcacacaatttttccagtttgacatttggtgttttttttttttttgagagacagagtctcactctgacacccaggctggagtgcagtggcacaatctcagctcactgcaacctcctcctcctgggtttaagcgattcttctgcctcagcttcccaagagctgggactacaggcatgtgccactacacccagctaatttttgtatttttggtagagatggggtttcactatatgttgaccaggctggtctcgaactcctgagctcaagagatccacccgcctcagcctcccaaagtgctgggattataggcatgagccactgggcccagccaacatttggcttctagtgctatttatgtgttgttggtggtggtgctttgttgtacatatttgtagaattttatctaattatatctattacttttttgtttgtttgtttctgactttgcttttctgcttaaatgtaaagtctgcttagtgcatgcttatcttttttttttaagtatttctaattttaaaaataatgcacatttggaaggccaagatgggaggatcacttgagcccagtagtttgagaccagccttagcaacatagcgagaccttgtctctactaaaaataaaaaattacctgggcatggtggtgtgtacctgtggtcccagctacttgggagactgaagcaggaggattacttgggcccaagaggtcgaggtcacagtgagctataatcctgccaccgcattccagcctgggtgacagagagagaccctgtctcaaagaaaaaaaaaagtaatgcacatatactttaaaatggttaaaatggttcattttatgtatatttgaccacaatgaaaaaaaagtaatacacataagttgtagaaaatttgggacatacagaaaagtgcaaaaaggaaaataaattacccatagcccaacacccatggattataatgattaatagttttccttctatggaccttcatatatatacataaacacactcacacacatataaagatatataaggttatttcttttacaaaattgtgttcacactgtatataaaaattagtatccttaggccgggcgcggtggctcacggctgtaatcccagcactttggggggccgaggcgggtggatcacctgaggtcaggagtttgagaccagcccggccaacatggcgaaaccccgtctctactaaaaaatacaaaaattagctggtcatggtggcacatgcctgtaatcccagctacttgggaggctgaggtaa[136 bp omitted]taatgggtatttccctgggccattaagtatttaattatcaaataatattccaccatatggatgtgccaaaaatatgtaacaatttctcctttttttaatatttaggctttttctaattcttgagttatactaacattgtaatgaaaacctttgcattttttcatatctgtgatgatatccttaggctatattcctagaaattgacttataggtcacaaaatatgaacaattctaagactcttcatgaaatgtgcactccagaaaggttgtaagtttgtaattccaccagcactaaagcagtggctcagcttctaaactctcaatattcattgatattaattatcaatattaattgtcactttttaaatcattatgaacctaatagctgaaaaatagtatcccatcattttaattttaatttgattgattataagcaaggttgcactggccctttgtatttctttgtaagttttgtatttatgtccttgccctatttttctagaatattcaactttttctattcattggtaagaagtctttatatattaaagatattaaccctttgtcatacatttcatatatttttcccagtttgacatttggcttctaatgctgtttatgtgttggtggtggtggtgggtttttgttttgttttgtttttttagacagggtctcgctatgtcgcccaggctggagtgcagtagcagttcaagcatttctcctgcctcagcctcccaagtagctgggattacaggcacctgccaccatgcctggctaatttttgtatttttgatagagacacggtttcagcatgttggccgggctggagtggtgatgttttgttgtacatatttttagaattttatctaattatatctattagtattatcttctgtttctgactttgcttttgtgcttaaaaggcctattctatcccatgatcctatgactattcacttatatgttatttaaatacttttttagttgtgatttttacacttggcttcttttttttttgagacagggtctcactactgcccaggctggagtgcagtggtgcgatctcagctcactgtagcctcgacttcccaggctcaggtgattctctcacctcagcctcctgagtagctgggactacaggcatgcaccaccacacccagctaattttttttttttttttttttttttgagacggagtcaggctctgttgccaggctgaagtgcagttgcaccatctcggctcactgcaacctccatctccctggttcaagcaattctcttgcctcagcctcctgagtagctgggactacaggcacgtgccaccacacccagctaaatttttttttgtatttttagcagagacggggtttcaccaagttggccaggatggtctcaatctcttgacctcgtgatccgcctgccttggcctcccaaagtgctgggattacaggggtgagccgccgtgcctggccatcatacccagctaatttttgtattttttgtagagacagagacttgccatgttgcccaggctggtatcaaactcctggactcaagcaatcctacccatctcaaactcccaaagtgctgggattacaggcatgagccactgtgcccagccttacacttaacattttaatacatttagaatttacctggtgtggcagggtgcagtggcttgtacctgtaatcccagcactttgggaggccaaggtgggcggatcacctgaggtcaggagttcgagaccagccgggccaacgtggtgaaaccctgtctctactaaaaatgcaaaaattagccgggtgtggtggtgcgtgcctgtagtcccagctactcaggaggctgaggcaagagaatcacttgaactcaggagatggaggttgcagtgagctgagatcatcccattgcactccagcctgggcaacagagcaagactcagtctcaaaaaaaaaaaaaaatttacctggtgcacaggtgccgtgactcctgcctgtaatcccagcactttgggagtttgagataggtaggatcacttgaggctaggagttcgagaccagctggccaacatggtgagacccgtctccataaaaaatacaaaaattaactgggcacacctgtaactggtgcacacctgtagtcccagctacttgggagactgaggagggaggatcacttgagccctggaggtagaggctgcggtgagccgtatttgtgccaccacactccagcctgggtgacagagcaagaccctatctcaaaaaaaaaaaaaaaaaaaagaattttcctggtgcatgatatgaaacagtcatctaagttttttttttaatagtttaccaattgtttaagcaccattttttgaataattcttttctccactactttgtgctgcagctttcaccacatactaaatgtttatatctattctagggtctctatcttaatgaccataactttagaaaaatgccttttttttttttaatttttttgaaatggagtctcgctctgtcgcccatgctggagtgcagtggcgtgatctcagctcactgtaacctccgcctcccaggttaaagcgattctcctgcctcagcctcccgagtagctaggactgcaggcatgtgccaccacgcccggctaagtttttgtatttttagtagagacaaggtttcacc[139 bp omitted]attgtttttcttttcaacatttccttgattattttcgggcatttgttcttcctgataactttagaattaccttgtgattatgattggaattatgtaaaacccatacacttggagtaatttatgtaaaatatttcatcttttattcagagacacagtatgtctctcctttactttcaatcttctttctttagcttgaaccagatgaaattaccaatattcaactttgttgacatcattcaaacagcaatttcatctggttcaaaccttagaaaagttgttttcttcaaagggaaattatgctctctctaaacaaacaaaaaaatagtttctcttaaaaaatctggggagaagtagggtaggaaagaagtatgatatactgtaagtgttttattcattttttaaaaatcctggtcctaagaatttctcactgccaggggcatctctccagcactttcagccacttcatgcctagttcaaggcttcgccagcttagcttcctccccatagtgggccagtccaaaacaaccagggccttgagcctcaaggggtagggctagtccgtgaaaaagggtttcaggccaggtgcggtggctcacatctgtaatcccagcactttgggaagccgaggcgggtggatcacctgaggtcaggagttcaagaccaacctgaccaacatgatgaaaccccatctctactgaaaatacaaaaaaaaaaaaattacccaggtgtgttggcacgtgcctgtagtcccagctactcaggaggctgagagaggagaatcacttaaacctgggaggcggaggttgcagtgagctgagattgtgccaccacactccagcctgggtgacagagcgagactctgtctcaaaaaaaagagaaaagaaaagaaaaaggtttcagatgaagttcaatgacatctaaatgggacgggtaagggtcccagtcttccccataaaccttagttttgctttctcttcctgagagctagaacagtgacctcatctgggagaatccagccaacaccgcattctacaccatctgcattctatacccctaccacaacaacccactataaactggggtaagatacactagaagtgggtatttgggggtaatcctgatcatctttttcctcgtatgggagccttccaaataatgcatatatagagcataagaagaagtttcaaatagatgcaaagtcatgatggttgtaaaaaaaaaaaaaaaatccaaagaggtaattgcactgttttcacaaaataggatcaacatgtaattatgaataacaatataaatgtcatccaaagatataggaagtgaacttttagggtttcagtgaaagtgttattttgcaggggttaataaacatactaatactttgtccaccctatgttaaaaaaaaaattcacccccaagacagaactgcaggctgcttttaaatgcaaacatggcattgggcttctctggccattagatgtcactgcagtaaatggagagtagctgagcatcacctgattggagcctgaagttcggtgatctctgtccagttaacaacttcataatccctgcttgaaatccatctttggtttggagaataagaggcctagaaaccacaggctaatgctaaacttgttggttttgttgttactgttacttgtcctacaaagcacacactccaaattcaccaagaagagagggctttaataacagtctgtcctcgctggagcaggcagggtttgccagcagaataagtaacgagggacctttgcagggccactgggctgctctgacctgagcacacttaatggcaacatttgcattccattggctttccccattgcactgcctgtcatgaagcaaatcaatggcaggtgtctgttggataacgagctacacagggaatttttctcgatccctgcactgactggcccctttgtctggatgtttctttctcttaatatgcttttctctagacacacacagcccatttaatggcacatcaggttggaactcttttgaacataatgacagtaatcagaagtcttgtttaaccagctgagcccttccttcaccatgcttacactcattttatccctttttccttttcttgccttggctcctggctggcatgctagagaatggagaggtaaataaattatgcatgtgcatgtcttgatagaatggcttctggtgggaaggggggtgggtcaggcctgtgcacacatggaatgaggtgcccccaacttggtgtgctttcacggaccccaaccaccctgcctgaaatccccttctccacgcttcagtgcatcttagctcaagcccttccaggtatagcctggcctttttgtctatctcccacacctagcccagggcctgggccagaagagatggcagaacttagtgtattgagagaacaagtaggaagggtaaaatattgacagagatgaattcatctgattaatctgtgcaccccgaataagaaccagggagtcctgagaaaatggctctctgcacaggtgcatgtgaagaagagagggagataggctggggaatactgccctgaaaatccagggagcagctgagaatgtaggagccttggaatctggcaggccttctgaaaggatcaggagggaggtaccagacacatgctcggtccccccacaactctgcctgacaccctcccctattgcccatattaggtgtctccatttcatcaaatataaaaccaagtgtgagcctgttgctttataccccagtggactttgaccccatcacagctcacaaggtaagcaggattgggccaggtcagcatttgaactgaaagcacataagatgaaggacaaaggtggtatccgagtggtacagctgactgagcagaatatacatggtcagtgaataaacagaggccccagcctactcaaatagagatgctcgacacctcgggttacctttgttgaattggacacagtcacttcattcattccctctcagggtgctcatcccctcttgtagtttttcatgttcatatctacatcttcaatcctgacctcccttctgagccatggtcccacatttcccacagcctgctcgacatcactatttggctatcatatccccactgtcacctctaacttaatgtgcatcaagctgacctcttcttttcctaacactgttattccagagttttccatttcaattccatcattgccccagtgactcaggctggaaatccacaacttgtgtttgactcttccccttcccctcacccggttaaccttgagccctgttgcttcttcattcctaacattcccatgctggtctttctttttgtcactgcctcttgccctaatcttggaccttatcagctcatacctaggctattacagtaatctcctcattggtctccaggattaattctaaaaatgatcttaagcattgaatattaatatgtactaggcactgtgctaagtgctttatgttcattatctcatttaatccttacaacagccctacaaggtgggcactgttattattaagtccattttacagatgagaaaactgaggcaccgaaaggttttgtagcctgcaagttcacccatccagtaattgagctgggatataagcccagggagcttgtctccagagtcagtgctcatttcaatcctctccagcccagcccatatgggattctgtcagatgaatctttctcagatctgtctgcgttagatccttttttttttttttttttctttttgtgagacagggtcttgctctctctcccaggctggagtgcagtggcacaatcacagctcattgtagcctcaacctcccgggcccaagcaatccttccacctcagcctcccaagtagctgggaccacaggcatgcgccacctatgcctgactaatattttaaatgttttgtagagatgaggtctcctggtctccttatgttgcctaggctggtctcaaactcctgggctcaagccatcctcccgctttgacctcccaaagtggtgggattacaggcatgagccactgtactcagcctgttgttgtgtccttcttgatggtccccagagaaaaaaggctgagccccttggcttggcatgtttcccttaccaactgtgcgatccttgttgcacagaggccctttatataagaagttacaaaaacaaatgcctgcagaaacttggaagtaacatgaaaaagagaatgtagggaaacccagataacatacactcaccctgtaaagaataagccttcaggctgggcctggtggcccacgtctgtaatcccaccactttgggaagccaaggtgggtggatcacttgaggtcaggagttcaagaccagcctggtcaacataatgaaaccccgtctctactaaaacacacacaaaaaaattagctgggcatcatggcaggtgcctgtagtcccagctactcaggaggctgaggcgggaggatcgcttgaacctaggaggtggaggttgcagtgagttgagattgtgccactgcactccagcctcggtgacagagcgaaacttcatctcaaaaaaaaaaaaaaaaaaaaaaaaaaaaagccttcaaatgcattccgagccatcatggctttcaaaagcattctggagagctaaacttcactgtgctcacaaaatgtgatttgcatctaaatatggatgacagaaaggaagaaagagagccagtagaggctgtggccagttcctcctctccaaaggacggatgccatttagaaatgtaggcccagttttcaaaggagtctaaaatccagatttttatgtaaaatctcccagtttttcactgctggcaaatgaaaattgttaagtactggctgggctaaacaaaacacacattcgtatgacctctgctctattcaagcctccaagttcatcaaactaatcttcttagccccttctcccaagccctgaagactaagtgcatttcacattccagtcaccaggcctttgttcatgaggttacctctgtcttggaacatctgcccaattttcttaaaggctcaactgaggtttgtctcagtgatggctgtcttttctgacctactgtagcacatacctgttgtttaagaaatgagttggcttttcccatccccaaaacagctgtcctatcttgatggatcaaggtagatgttttgcctttgtagaaccacaatggaggtgctccagcccacttcagaggggattctggggcaagagaagctgagttaactaacaatctactcagttaataactgcagatgccgtattttcactgtcccccacccaacccccaagggcatagttattttgttctaagagctttgtgggtgaataccacccaccccctttttatttttgagacaagagtctcgctctgtcacccaggctggagtgcagtggtgcaatctcggctcactgcaacctccgcctcctgggttcaagtgattctcctgcctcagcctcccgagtagctgggactacaggcatgcactaccacacccagctaattttgtatttttagtagagatggggtttcaccatgttgcccaggctggtctcgaactcctgacctctggtgatccacccgcctcagcctcccaaactgctgggattacaggcatgagccaccgtgcccggccaaataaccccttttaaatgatgctgttagcctatacgtgccctctgatccagccagtttcttttccatggcatttctgtccatgccctacctcttcccatcttaacactattgccctgctgttccctcactatcaaagccgcctcctgaagtcttctcccatctccccaagcagtagtctcccgctcctgaatggctcactcttgctagagctgtcttatggcccatgccacatgcttccttttgttataatcttttgtgtcccttatttcctctagattgcaaactctttgcctgtgggaagtatgtcttacacatttgtatatcctcacaacacacagcctcatgtagcagacatctaatacttgtttaaaaatgaagtttagggacagcttaggagatctcgctgtctgctaggtgagtcccaagtccgtgtggttgtacctacccaagatgaaggtaagaacacccaagcctgcctcctgctcaacctgctgccctaagaaaacctctgcatgtcccctgtctaaaactgtctatgcacttcgctctgagaatgcactgtcttccatctcctaccctagcaatcaggttctatgcatctcagtgcaaacagccgttaacgtttcaggatagacaaatatgctaaaaggacaaaaggaaaaattcttgacaccattttgatttacacctcctcttcattccagcctcctggcgctttgtatggtggctggaagtgcttgacaaatcatagcaccatcaaatttatacagtcgtccctaggtgtctgcaggccattggttgcagaatccctctctgataccaaaatccactcatttctcagccctgaagtcggccctgtgaaacctgtggacacaaaaagttggccctccttatacacaagtcccgcatcccaaatttgattgtggatgcagaacccacagaaacagagggccgactgtatttattgaaaaaaatccacatataagtgaaccagcacaactcaaatccatgttgttcaaaggtcaactgtaggccgggcgcagtggcccacgcctgtaatcaccacactttgggaggctgaggcaggccgatcaacggaggtcaggagtttgagaccagcctggccaacatggtgaaaccccgcctctactaaaaatacaaaattatcctggcatggtggcacacgcctgtaatcccagctactcaggaggctgagacaagagaatagcttgaacccaggaggtggaggttgcagtgagctgagattgcaccactgcactccagactgggcaacagagcaagactctgtctcaaaaaaaaaaaaaagaaaagaaagaaaaggaaaaaaaagaaaaacaaaagttggttgctttctgtaaatgtgaccagatttgaatgaatgcatgtaaatctatgctgtactttgctggggaggtttttgtcagggataaggatgggggcaaactatgttaagggaagtgatgacaagaaagccttccctgcgattaagaaattataataatatatgcttaactggcaggggagataccatgatcacaaaggtggttttcccagggcgaggcttatccattgccctctggatgtgctgacccctgcgatttccccaaatgtgggaaactcgactgcacaatttgtggtagtgggggactgtgttcgcgctttcccttgagaaaaaaaaaaaagaaagaaattataggccgggcacggtggctcacgcctgtaatcctagcactttcggaggccgaggcaggcggatcacgaggtcaagtgatcgagaccatcctggctaacacggtgaaaccccgtctctactaaaacacaaaaaattagccgggcgtggtggtgggcgcctgtggtcccagctacttgggaggctgaggcaggagaatgccgcgaacctgggaggcagagtttgcagtgagcggagatcgcactactgcactccagcctgggcgacagagcaagactccgtctcaaaaaaaaaaaaaaagaaagaaattataataatataataataactaccacttattggtcacttaatgtatacaaggcagtttattatcccatttaactgtctttattgaccctatgaaataagtactcttagtactcctattttatagatgaggaaacaaggcacaaggtgtaagtcacttacccaaccatcacatagctagtaagtaagtggcgaagctgggacttgaacctatgtctctccttcctcaggccctttttttattcaccaagagtacaggagcctaatcctgtaggcaagggaactggatcattttgactttagttcccttgccccaggtgtgggactagaggatgagggagcgggaaagcaaaccttgatattgggagtccacagcctcagtgcaagagttgagaaaatcaatactttgcaagctcagaaactgagaggccatagccttgtcttaatccgttcaggctgcaataacaaaatatcataaactagatggcttataaacaaccaaaatgtatttctcaccgttctggagactgagaagtccaaggtcaaggcagatttgatacctggcgaaggccagcttcctagagccttcttgctttgccctcacatggtggaagggggagctagctttcttccatctcttttaaaaggacccgaatcccattcatgagagctttgccttcatggcctaatcacctcccaaaggccctgcctcctaaaaccatcaccctaggagtcaggatttcaacagatgaattttgggaggacacaaacactcagagcataacgagcctggctttggccagggaatggttaactcaagttagagagaggaaaaaaaaaaaatctttggaaaactgggctgtcctggggtctgctttagtccctggcagtctggcaatggaaagccctacttgttgctttgacttgagaagccgtaatgagcagtgagccacaggcatagaccattcagtagacacaggtctttggccagccttgaacgacaactgctcagagggactgggaagaaagcccgcctaccacagggggcagggctgggagcagaagcaaagccccaggatgggagagtaaattgttataactatccctgcgaggaggtgctaacaaagttccaggttttctgcctacttcaatatttcccggttggcatagcatctactcttagtaggaacagagttctatttgcctaacagagtcaaattacctgtccagaggtacaaacactgctaggttctaagccttcagggtagtggagaggagtggagccttacctttagtttgttgtattttcaactctctgctgtcatcttacttttaggtctggcccctttgtgaaccaaattcttctaactgagtagcattgcgttagcagtcagaaaaaaaaaaaaaaaagatgcttttcaaatataggtagatgtctggacatcccttaggcaaggtggctctgtatgagcgtcactattaaagtgaaaggaaaggaaaagtctccccacccttgtttttttttcaaaaggtatagagtgcccgaaatactttagggatggcagctgttgagcatggaaacaagacttgtccctagagggaaggcaaggaaggcatggggaagagccttcctaactccacttagtgtaaaatcactctgtcctcttcccctgacctgagctggcttattccttggaagagataaagatctgggagtcaaaatgaccaccctgtgctgagcaggcttctttgaactccagctaaacggtaacagcacctaagataggatgttcccaccctcactccccacctcaaagtggaggtgaagagggagataagggaaagggagagaaaggtcccaggaaaggtctgctgtcaagagggaggacccgcagctggctgggagcattcacaggaagtaccaattttcacctccttttttccacagagctgttgcttatttgcctacgacggctgtgttcctcttgaggctgtaatgggcagactagctcagtgggtaacagtgtgagctttggatcccagccttgccacttactcccgcgtgaacttgtgtacaccacataacccatctgagcctcatcttcctcatctgttttgagggtaagaatggtgcctacctcatctacttgcagcaaagactaaattcgtttagtgcaaatgcagagccaggcccataataagtactgtcaataatgctaagatgccatgtttattgttcttgaagcatcacttcagaatctgtgcacagcat[137 bp omitted]cgaaaccccgtctctaataaaaattaaaaaattagctgggcatggtggcgcgcgcccgtagtcccagctactcaataggctgaggcatgataatcacttgaaccaaggaggcagaggttacagtgagccgagattgcaccactccagcctgggcgacagagtgaaactctatttaaaaaaaaaaaaaagccagtccagatgtgtttccatgtttcctatgattactataaacacacaaatgagctgggctcacagaacctcaatagaccttggatatgtatagctaatgatgagcagcgacaggaatcgagagttcgtacagaattttttggtttggttagcgtaacaacaggctttacagacaggctccatgtgcaagcactgcacacctctgtatgttctcagccttctgagaactgtcactgccaaatcttttccttcaccctccccaccctatctcacccccaggcaaggtgacactttcaaagttggcacggcaggcagcacatgccaggcctgtgacccaggcctcagcagctctgctcacttgcatggcaattgctttctacagtcaggcccagctgcactttgggtctccccaacccccacccccaatcaccacacaggaactggctgtttctcttttcttcgtccaagctgaatactaacctactgtggtttgcttgcttcccccattgtgatcgcaggctttctgagcagctagtcaaccctctagcctgccactgaatcggaaggcattcacactggaggggatcaaggggagcttgtaggcttgccttgctggcgggcagctgcctacacccactcgtaccaatgtccccgctgcagagcccgggtgcttcccagctgtacaaggacaactatttgggtcccggctatgccaagagaaacatgggtcatgtggttcacaggacagaaaggttcatttactccaatatgactggcatttttttttgtttgattattggatatttgccaaaagactgaagcctcctgccacaaccacctcccccacatatatgtcctcagatggtttgggaattggacagcttagtcatcaggtcctgtcctccacatccacagaagatacaagttgtttccagataacatgcagaaggttctgagctccttcctgtgtgctccagctcgaagactcttttcttttccctatgaattttttttccttttctttctctggtctttcctttttaatgcccttttaaaattaagtattctatcttttgagtgggtaacacatacacatgatacaaaatccaaaaggtgcaacgagtatatgctgaaaagtaaacctctctaacctttgtccttagccattcagctctcctgtgagtcagtactgttgttagcagtttacctgtatctttccaaagatggtctatgcaaagatccacataaacttgtacatttatgttctgtttttaggtcagcagcagcacactacatacactcttctgtgccctgttttttttccacctgaaaatgtatctcggctgggcacggtggctcacgcctgcaatcccagcactttgggaggccgaggcaggtggatcacttgaggtcaggagttcaagaccagtctggccaacatggtgaaaccctgtctctactaaaaatatgaaaattagctgagcgtggtggtgggcacctgtaattctagctactcaggaggctgaggcggaggaatcacttgaacctgggaggcagaggttgcagtgagccgagatcacaccattgcactccagcctgggtgataagagtgaaactgtctcaaaaaaaaaaatgtatcttggaaatgataccacatcaatccagataaagctgccacatatttttcatttatgacatagtattcaacggtatgatatactatttatttaactagtccctgattggtggacatttagattatttccagtcttctgctagtactaacaatgctgtaacaaatctccttgttacatacatttttcacgcacatgcaaatagatctgtaggataaaaaggggtccccaacccctggtccgtggcctgttaggaacctggctgggccacacagcgtgaagtgagtggccagcgagtgagcattatggcctgagccccgcctcctgtcagatcagcggcggcattagattctcatagcagtgcaaaccctattgtgagctgtgcgtgcaagggacctgggttgcacactccttatgagaatctaatgcctgatgatctgagatggaacagtttcatcccaaaaccattccccccaaccccttgtccgtggaaaaatggtcctcggcaaaaccagtccctggtgccaaaaaggttagggactgctgggctaaattcctagaatttttgctttggtcaaagggcatatgtgtcttacatcttttttttttttttttgagatggagtcgccaggctgaagtgcagtggcgcaatttcagctcactgcaacctccacctcctaggttcaagcgattctcctgcctcaccctcccgagtagctgggagtacaggcacacgccaccatgcccagctaatttttgtattttcagtagagacagggtt[139 bp omitted]cagtactcatggaaagactgaacaaccaaaacgttgcctctgttggaagacctctgaggaatttatcacaggaataatcaagtgctttgcttttaagtctttgttctttatttgtatctactgcaagtttgttatttctttccttcaatatgtattaaacacctcgacctctaccatgcaccaggtaagctttgaggccaaaaccataaacacaacaaatgtggttgctgcccccacagtatttacagtctaggagatggagcagttgggggcaggagtacacatgaacgaaataattatacactgagtcattacaaactgtgttaagtgccatgaaggagaagcacagggtgactgaaagtgttcagtaggctcctgacttcgtgtggaggtctcagaagatttccctggggaaatgatgtttattctgatcaataagacagacttagtgaggccgaggaaatggcaggtttgaagtcctagaggaaggcaggagcaaggattctggccagcagcatggattacaggatctggaaagggtcttcaaggacattttgtttcagtctcctcatttgacatgtgagaaaactaaagtttagggagctaaatgacttgaccagggttatacagatagtaacaaagtcaggctgcagaatccagtgtgctcatcctgggagctgtgggtctgaactagacagctatgggatagttgcctgggtttgtgtagaaggacttaagttcaggttcttgtgacaagctgcgtgacatgtttcatttctctttactagtaagatacagtttggatgaatggccattccaatctagcgggttggtttgttcttcagcatacttgtctttcttacaagtttaaataataataacaatggtggttaattctttagcgcttgctctatgtcaaatacagttctaagcaacttacatgtattaaatcatttcattttgacagcagttcttaaagttggtgttattattattaccccattttacagatgaggaaattgaagctccagaaggtaaaggcacttgccaaccatcacagagctagtgagtggcaaagcagggggaccgagtccaaacagtctggcttcagggcccatgtgctttgtctcccaggcactctcagtgtcagcagcaggctgatggactcaggtttgagcccagagctgccttgtgccatggaaggtccaatcagtggctctcaaccctggctgcacatcagaatcagctggggagcttgtaaaaagtgctaatgtccaggcctcgcccccgttcagttaaattgcaatctctaggggtggatcccagtcactgagggtttttaaaagcttccgtggtcagcctaatgcagctaacggttgagatgtactgggatctaggcttgccattgctttgccctttgggagcaaccagcaccccatacttgcctttgtgttctggacacccacttagtaggacacttgtagaggcacttattcataccacagcacaggctcctgtctcagcctaaagaactcattcagtgtacatgctttggcagccacatccaccagtgatgtgcggtaacaagtctgtaaagggctaagagaatattttcagtcctgagcgtcagaagacagtggagcttagtggagtggagcttggctctgagtcaaacagacccagattcaagttgatgctttgtgtcatggtctgtgattttagagactggcgtttatcctctcaccaactccattttgtcatccatataatcaagctaatacgataatactacctctttcatgaggcttttgtgaggatta[132 bp omitted]tgaaaccccatctctactaagaaaaattagccaggcttggtggcagtcacctgtaatcccagctactcaagaggctgaggcaggagaatcgcttgaacctgggaggtggaggttgcagtaagccaagatcgtgccactgcacttcagcccggaagacagtgagactgtgtctccaacagaaaaaaaaaaaagaaaagaaaagaaagaggaaaaaaaagaaagaaagaagaaaaagaaagcactcagtgctaggccatgtctttatttcatgactatccacgtagcttatgtgagtaaacagctatatttgggaaaagctactagtgacactgatattgacaggaatttgatttgacatttaataagtgcctggtatgtacaatgaagagtgaaagatcctgaagagcttggatgactaggaaggccccgtgcctgctgactggcttgctggctgggagggagcataaagacacccagataactcatataaggtagagtgtgccgcagcagaggtctaaacgagaagctaagggaggccaggggcggtggctcatgcttgtaattccagcgctttgggaggctgaggcaggtggatcacttgaggttaggagttcgagaccagcctggccaacatggtgaaatcccatctctactaaaaatacaaaacagctggacatggtggcaggcacctatagtcccagctacttgggaggctgaggcaggagaatcacttgaacccgggaatggggaggttgtagtgagccgagatcgctccaaaaaaaaaaaaagctaagggagcacaagatatggagagagaaagccccaattcaaacagaagctggaaaacaattataaaataaccaaggaaatatgaatactaactgaactcaatatgtgatgatattaaggaattataaatttttaggtgtgataacggtattatacatatatttttgaggagcaattatagtttagataaacataattctaattaataatatgtaagtcagatgaattgaaatgatgtctcgtgggggtagagatgaaagaagattggccacgtatagctaattgttgaagttgggtgatggaactttgtgttcattttactggcctctctacttttatatatggttgagatttttcacaataaaaagttttaaaaagagggccgggcacagtggctcatgcctataatgccagcactttgggaggccaaggcaggcagatcacttgaggccaggatttcgagaccagcctggccaacatcgtgaaaccctgtctctactaaaaatacaaaaattagctgggcgtggtggcacacacctctaatcccagctacttggaggctggggcaggagaatcacttgaacctgggagacagaggttgcagtaagccaagatcgtgccactgcactccagcctcagtgacagagcgagattccataaaaa[136 bp omitted]tggtgaatccccatctctactaaaaatacaaaaaaaatagccggttgtctgtaatcccagctactcgggaggctgaggcagagaattgtttgaacccgggaggcagaggttgcagtgagccgagattgcaccactgcactccagcctgggcaacagagcgaaactccgtctcaaaaaataaaaataaaagagagaggtaaagttgaagaaaaggaaggaaacaagcagtacacaattgtggaatctggaaaattttcaggatgaggtggcatctgacttgggcatgggtgactagggagagttgatgtcgcagtttaaatctgaagggagtctgctggcagaatctcctcttccttgaggggcttcagtcttttttcttttaaggccctcactgattggaggaggcccactcacattatggacaggaatttgttttactcaaagtctactgatttaaatgtcaaactcatcttaaacatgcctttacagcaacatctagactagtgtttttcccaaatagctgggtactgtggcctaaccaagttgacatatgaaattaatcatcacagggtggcagtgggaaatgatactaggaaaaccggtaggggccaaattgtaaagggttttgaattctgttaaaattgtctttagtaaacttctttggaaaatttttcttctcaaaatgttttcgttagaaaattgggaattgttgaaggcttctgagcaaagcaatggtaacatctgatgagtttggaagggtacttggctgcaatgtggaggatgagttggagagggcagagactgaaggtcaaatgatgggtaaggaaactgacccttgcttaagagagatgatgtgaggtactgggagtagagctgaaaagtatccaaagcatagaatataatgcaggtagcagcaagagatcaggctgagcagtaggcagaggccaggtcatggagcacctggtaagccagattaaagagcctggagtttatcctgatgataatgggggacccactgaagagttgaagtcaagggagtaacctgattaaatcgctctgactgctagatggggaataagggcaggtagaccagctagtaacagttgtagtagtgtgggcaaaagatgatggtggcttggactagggtgagagtggaaagaaagaaaagtaaacaaatttgggacatgtttggagccactggaacttggttagtgatggattagatcagagaaaggtgagagacagagaaaacttaaaggtgactcaggttttgggcctgagcaagtaggttgatgacagtgccatttgctgacatgaggaaaactagaggacagtcaggattggagtggagcaaaatcaagagttctgattaggacatataaagtttcagatgttcagtagacttctgagtagcaatgtcaagtagctagttgattacatgatcctgtggctcagaggagagatacagatagaaatttggaaatcatcaagcagaggagaacagaaagaaggccagtgcagttgaagggttttgtgaccctttatcttgggtcacaaaagagtgacccaagataaagttgaaaaggtgggagggtcaggcatggtggtgcatgcctgtggtcccagctactaggaaggctgaggaaggaggatcacttgagcccaagagttctggactgtagagcactaagctaatcagatgtccacattaagttcagcatcactatggtgacctctcgggagcgggggaccaccaggttgccaaaggaggggtgaaccggcccaggttggaaacagcagatcaaaactcctgtgctgatcagtagtgggattccacctgtgaatagcctgtgttgcccactccagcttgggcaacatagtgacaccacatctctgttaaaaaaaaaaaaaaattttgagacagagtccgctgcgacgtccaggttggagtggaatggcgtgatctcggctcacttcttcctgggttcaagccatctctgcttcctgggttcaagccattctcgtgcttcagcctcccgagtagctgggactacaggcatgcgccaccacgcctggctaatttttgtatttttagtagaaatggggtttcaccatattggccaggctggtctcaaactcccaacctcaagttatctgcccacctcggcctcccaaaatgctgggattacaggcgtgagccactgcacccaacttaaaaaatatttttttaaaaaaagaaaaaaatcggtgggcagagcagatcatataggaccttgtagcctacgagcatgctggaaccacttcctactggctcaggagaactgactgttaaatttcaggaaatttgggagctggtcgacttcgcatttggcagcctgaaatcagccatagtgggagtactgatgctgttgaaattggtaaatgctacaattcagcccttttttattttcccccagagaaccagttgttaaactttgccaccatattagtactatggcttgtaggctccagtaagaaatttagattttattcttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcataattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagcatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccacatttcttggaggctttgctcatttctttttattcttttttctctaaacttcccttctcgcttcatttcattcatttcatcttccattggtgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagactgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtcgtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccgctttgttttctttttcatctcagtttttgaggataagaatgctttgttttaaaagggatcatctgtgtctttttaaaagcttactgaattttcctggtgtgaattatttgcacgtactcatttttgtggttgatttggattttacagtgattaagattttacagtacctgctccaccgggcccagatcctgcttcccagatcttcctgggaagcaccaagaaatttagattttattctaagtgtgatgtaaagtcattaaaatgttttaagcag[142 bp omitted]aaaccccgtctgtactaacatacaaaaaaattagccaggcctggtggtgcacacctgtaatcccagctactcaggaagctgaggcaggagaatcgcttgaacccgggagacggaggttgcaatgagccgagattgcgccgctgcactccagcctgggtgacagagcgagactccatctcaaaaaataataataataatacatcactgtacaagaatggactcccagtgggagaaggcaagatcgctaaggaaactgctgcaacaatccacatgcgcagtggtgccttggcagtgcaggtaagagttcagtcaagaaatttggaagattgttaacatcctaagactggatatagatggaccttgatttatcacaagttgattataattgacctgttatgtaattcgtgttacttagtgtctttttgttttagttgtggggagcaccagattacagaatgattaccttgactcatgacccagggctctttacaattcttaccagaaactggcagatgataaatcagtcatcttatttggtagcaaaataaggaggttactttcctgcatgaacataaatttcctcttttcaatatttcagtcttacattagcaggaggaacttgaagtcttgtgattaggcagattctttgtaagggaaaaggcagcttactatccttttggtaacagttctttactgatagggtaagaaggaaaggaggttgagtccgaacaatgctaaaggaaacactttaaagtaagacatccactgaagacccctagccattttgcctactgtaaaatagaaccatctacaatgtcttgtgaagagagaaatgaaatgaattttgatatttgttttctgcaaagattctacattacattgtgtaagtcttgacccacgatttttataactcatgcataaaattatgtgcaaatgctttaaaaattccagcccactcttatactgagcattttatgtactcattcagcaaaccattcattgagcaccagtcatgtgtcagctgctgcttaaggcactagagatacgaaaattaaaaagacccagtcctcacagagttcacagaacactaggaaaaatagacatgtaaattggacatgattacagtacaattgtgaaagaggtctctttgaaagagttgtctgtatttatttaccatctccagtctttcttttcccattctctctctttttttttttttttttttttgagacagaatctcactctgtcacccaggctggagtgcagtggcacaatcttggctcactgcaacctccacctcccaggttcaagcgattctcatgcctcagcctcccgagtggccgggattacaggcatctgccaccatgcccggctaatttttgtatttttagcagagacagggttttgccatgttggcaaggctggtttcgaactcctgacctcaggtgatctacttcccttggcttcccaaagtgctagaattaacaggtgtgagccaccgcgcccagcccccattctctattctctctctctctctcttttttttttttttttttgagacagagtcttactctgttgcccaggctggagtgcagtggcacaatctcagctcactgcaacctccgcctcccgggttcaagcaattctcctgcctcagcctcccaagtagctgggattacaaccaggctgggagattcagcttgtccatttcatgttctgtttctcacaatcatctgtgtttgcttgtcactgcactttaaagagaaggcataactcaaaagtttcacccttcaacttgatggagaattattttttatttatttatttatttatttatttatttttatttttttgaaacagggtttttctctgttgcccaggctggattgccgtggtgcaatctcggctcactgcagcctcaacttcctgggctcggtcgatcctcctgcctcaggatctactccctcctgagtagctgggactacaggtacatgccatcatgcccggctaatttttttttcttttgtagagatgaggtttcgtcatgttgcccaggctggtcttggactcctgggatcaagcgatctgccagcctcagcctcccaaagtgctggaattacaggcatgagccactgcacccagccattctatatttttaaagcatagaatattgattctttgagctggattaatgaggaaagatataacaatcattaatataaaataaagaattgtgaaacctcattaatttgcatgccactaacctaaaattgtaataacccagggcttagtaagcaaattagtcatataaacagcataactatagggatatttaaactgtttaccaaaagaagctgcttttaaagcctgctgaagtacttatttattactaataatgtctaatattattgacacttataatgttgctggcactcttcattgtcttatttaatttccatagcaactctaagagctaggtatta[132 bp omitted]aaaccccatctctactaaaaatacaaaaaaagccaggcatggtggcaggcacctgtaatcccagctacttgggaggctgaggcaggagaatcacttgaacccaggaggcggaagttgcagtgagccaagatcgtggcattgcactccagcctgggcaaaaagagtgaaactgtgtctcaaaaaaaaaa[131 bp omitted]gccaacatggcaaaaccctgtctctacgaaaaatacaaaaattagccaggcgatgtggcacgtgcctgtaatcccagctactcaggaggttgaggcacaagaatcgcttgaaactgggaggcagaggttgcagtgagccaagatcatgccactgcactgcagcagcctgggtgacagagtaagaccctgtctccaaaaaaaaaaaaaaaaaaaaaaaaaaaggaacttgcttaagatcaaaaatagctaatgagtagaagagacaagggttccaatccaggtctgtgtgatgctgaagcccacaggcagaagattcgcactctacctaggcttccacagatcactcaaccatgcatgaaagtaaggcctgaaaagtgtctctactaggttgcccttcattaatctagttccagtcatgtataataaaatggagtgtctttccaaaatttcataatttagatttcactcatttaggccgacttcccccctatacatacccactagttggaattagttgccttttactatatgctgtattgaatgtccttatagttgggggtcatgagaaaagctaaagtctaacttggacaagatgacgactggcattgccagggttgtgcagcaacagtagtggggtggggtgtcctgcaaggacatgagttaggtggctgttaggggcagcataagttgtagtgtaaagccttggagcctagatgccaaggtcgcagagtcaccaggaggcaggatcctggagtacagattgcagtggcccagtaggcacagcatctggcctctaggtctgcctctgctatgcaccagctgggggctttggttaagttgctctgcttctccaggtcataggtttttgtttgtgaaacgaataattggaagggaagatcttagggtccatttcagattggggtctctggtttagggatctgcgttatcagagtctaaagtaatcaagtccttggagatctagtaatcagaaggagagcaagaaagagccagctttcattgtcaggggcaacaaagaggtggctcatgcccataatcccagcactttgggaggccgaggcaggaggatcacctgaggtcaagagtttgaggccagcctggccaacatggtgaaaccccacctctactaaaagtacaaaaattagctgggtgtggtggcatgcacctgcaatcccagctactcgggaggctgaggcaggagaattgcttgaatctgggaggcagaggttgcagtgagccgagatcaaccactgctctctagcctgagtgacagagtgggactccatctcaaaaaaaaaaaaaaaaaaaaaaaaaaagaaagtccagaaagcctggtttgaatcagtaaaatcgagttttcacactgcttcactgattgtaattcattcttctacagatttttaaggagggtggaagagagaaaagctaagtaaaatgtggtcctagccatcacaggtctcatagtatcctgagggaaagagacaggaaacaactaactggaatataaaacagaataaaatgtgttcattacctgctgtatgaccttggtcaaatcacttaacctgtccctgagcctcagtttcctcaactttaacagacacataagcagtcaataaatgtcagcagctatgcatcagtagtggcaatagtaatatggactacatgtgtaatattttgtactatgccattacatcttagtaaaatagaaccatctacaatgtcttgtgaagagagaaatgaaatgaattttgatatttgttttctgcaaagattctacattacattgtataagtcttgacctaccgtttttataactcatgcataaaattatgtgaaaatgctttaaaaattccagcccactcttatactgggcattttatgtactcattcagcaagccattcattgagcaccagtcatgtgtcagctgctgcttaaggcactagagatacagaaattaaaaagacccagtcctcagagttcacagaacactaggaaaaacagacatgtaaattggacatgattacagtacaattgtgaaagaggcctctttgaaagagttgtctatattcaccatctccaatctttctcttcccattctctttttttttgagacagagtctcactctgttgcccaggctggagtgcagtggcgtgatctcagctcactgcaacctccacctcccgggttcaagtgattctcatgactcagcttcctgagtagctgggattacaggcacccaccaccatgcccagctcatttttgtatttttagcagagacagggttttgccatgttggccaggctggtctctaactcctgacctcaggtgatccacttgccttggcctcccaaagtgctagaattacaggcgtgagccaccatgcccagcccgattctctcttgagtccattccagtcagacttttgctccaccatccaataaacttctcttttattttttgagacatggactcactctatcgcccaggctggagtacagtggcacaatcatggttcactgcagcctcaacctcatgggctcaagcaaccctcccacctcagcccccccaagtaactgggactacaggtgtgcaccaccacacccagctaatttttatattttttgcagagataggggtcccactgtgttgcccaggctggtcttgaactcctgggctcaagcaatcctccccctatggcctcccaaagtgctgggattgcacatgtgagccactgcacccagccaaaacttctctttttatgataaccagtgacctccatgtgtttagatccaatggtcacttctcagtcttcatcttactgggccctcagcagctcaccactcctccttgacataccaccttcacttggcttcctggacaccacactttccttttccttcttcaccaactgctccttctcagtcttctttgtggggtctaatgtggaagtatccccaggctcaagccctaagtgatctcatctggtctcctggctttaaataccacccatgtactgatcactccctaattatgtctccggccctgacctctcccctgaactccagactcatgtagccaactctccatctccatttgaatggctaacaagcattgcgcagttgaactcctgatgttttcacccaccctcaaaaaacaaaaacaaaaagccaacctgcttctcccatagcgtcctccatctcagttcatggcacttctgtctatcccgtcacttaggccagaaactttagagccatccttgactctcctctcacaccctcatccagtccatcagccaatcctgttgactctaccttcagaatatatcgagtctgatcactgctcaccactccaccactagcatcccagtccaagctaccgtcatctcttgcctaaattactctagtaatctcctaaccagtctccatcctacttttccctccattcttgagtctttttcaacacagcagccagtgatcatgtgaaaatataaattaggtcatgccattcttctattcataaccccccccagtgaccagtcttctcagtaaaagccaaaattcttactgtgtgccctaccagccttatacaacctagccaccatttacttttgtgaagtcatatcccattactctctattttgttcattccattaccaccacattggcctcctcattgcctctgtaacaccccggacatgctcctgtcccagggcctttgaagatatctgtacaacttgcttcctcacttccttcagatctccaaaaagccatcttcttggtgaggtcttctctgattaccctaataaaaacttcagcatcctccagacactccttatgttccccctgcttttattttatccagagcactcacctcctcttagtatttggtgtaatttacttatttattttctttctttgtcttgtcttcccctgcaattagactttcagctttataggaacagggacttttgtctgtttggttcactaatgtatcctgagtgtcgggcatatagtaagtatcaataaatatgcaaataaatgaatagtctttagaggagataatgggagtataaaaaagagctaaggagtgcagtcagtatgattggggtgagtgatgcttttcatgttggaaaagttgtcatgaagggccttacatgtcattctaaggagcttagattttatcctataggcggtaaaatgtcagtaaagtagtcagtggtctgaattggaattttagaaatgcgttctggctgtagtataaagaatgaggccgggcacggtggctcatacctgtaatctcagcactttgggaggccgaggcaggtggatcacctgaggtcaggagttcaagaccagcctgcccaacacagggaaaccccatctctactaaaaatacaaaaattaggcaggtgcgatggcatgcacctgtaatcccagctacttgggaggctgaggcaggagaattgcttgaacccaggag[136 bp omitted]agcactatgggaggccaaggtgggaggatcacgtgagcccagaaattcaagaccagcctgggcaacatagggaaaccctgtctctacaaaaaatacaaaaattagcagggcatggtggcacatgccagtagtcccagctaccagggaggctaaggtgggaggatcacctgagcccaggaggttgaggctgcagtgagccgttattgcaccattgcactccagcctgggtaacagagcgagactctgtctcaaaaaaagaaagaaaagaaaagaaaagaaaagaattgaaaaggacaagagtgggtccaagaggccagtaacagactgctacagtaatgcacacatgagatggtggtagcctgaattatgggagtgccagtggggatggaaaggaggattgcttggatagggcagtaagggtgggcgaaatgaaggaattccaggtttctggcttggggtagcttgttaaagacttgggccattcatcactgagataagaaatacagaagaaagaataaatctgacactgtcaagaagaaaggcaacgatagattctaggtgtgtcgagttttgagtacttgtgtactatccaggtagagctgcccagtaggcagttaggtgcttggttttggaggtcagtgggaggtcagagccaaagataaagatttgggagccatctgcctgtaggaggtgtttaaagcaaaagctatggtagaatttcctagaaaaggtatataaattgaggaggaccaaaagagttcctggttatcagtgccaaatattgccccctaagaaatccagtaataatatagccaaaaagagccactggatttggaaaccaggaggtcgacaatggaatacatttcatttattcaaatgtttattaaatatctactatgtgttaagaatactaaggatacagaagtcaataaaacagatcaaaaaatccctccttacatgtagctgaaattctagttgcagagaaggagcagataaataaaggaaataaataagtaaattattccaaatattaaaaggcagtgaatgctctgaaggttagataagctgcctagggtcacagggccaagtaagtgaagaaactaggactagaaacgaacctgctcaactccagagttgtgctcttcttactgttgtaccacacctcctctcccacatcgataatcttggttccattgccacagaatgccatatagccccaactaaacatttcagaaacaaaccaaagtatgtgtatagcttaatctaaactcaacaccatttctgaaagccagctctgaggggacatccccttcacagtggacaggtagtaccagttttatatgtagatggtatattgaaaagtcatttcatctgatcgtaaaattatttttctaagaggatggctgggtgcagtggctcacgcctgtaatcctagcactttgggaggccaaggcaggtggatcacttgaggccaggagtttcagaccagcctggccaacatcgtgaaaccccatctctactaaaaatataaaaattagccaggtgtggtggtgtgcacctgtagtcctagatactcaggaggctgtgacaggagaatcgcttgaacccgggaggtggaggctgcagtgagccgagatcatgccactgcacaccagcctgggcaacagagtgtgagactctgtcgcaaaaaaaataataatattaaaggagaaaacgttcctttcagagatggagcattttggtaataatagggttccgtcaggatggctctgaaggtggtgatgatgtccacggggtggccaaaatggtataaaggtgaggatcactgaagccgaaggccagaaactggtcatgggctgggtcgtctttatagatgccaaagttacctaagatgacggcgaggctaggagagggtgagccaccaggtatcacagtcttcaatgaacgtggaagagtggccagattagtagataatagcaggccaaggagtatggttcagtgacatcagccccagctaagtgcttctgtcgtgagagtgaaggaggaagggtttgggaacagcaacagagagcgagaagaatgccaccatcacaatgctccctaccctgtcacatctgtgaggtggagaaatgaacagcctccgcttgggagcttcacaggggaaggaccagtaaagacaaggaaacagaatactttaaaaaggctaagggcatgggattatgtttatcatgtccagaaggcacaggttgggagggaatgtaagtatgaaattgaatctgtcccaaatgtctgcttccttccaggcaaaataaacgacaaatatatggacagggtatcatgattgtattgcacgttaatatctgttctaagcccacagaacaagaagaaccccacagcagccattctttgccatcatcttggccaggaacccagcatccagaatgtagacttgagaccctggctccttccactaggacatttatttcctaatgtttcaatcacctcatcccagcttctgtttcctgtcaggctcagagcccctacctcccacacagtggaggagtagatgtccatttctcaggagcagtggactgcttccggcagatagtgaaggcccagggggtcctggggctctggaatggattgacagccaatttactgaaggtgagaagagccaccagcctccgctgctcccctgcctcttccaattctaccctcttcctttgtcacccccaacccctactacagtttgcttggaaaaccccctctagcactaatgggtagcacaaggcccatgaatgcacactgtctgtcagccccgtagagaggggaacctgtgcagtggtggagtatcttataccccattccagaggagctgagcatttagtgcagagatacttaatgtggaggttcatgggcccctaatgggaacctaacccctcatcctaaaattctatgcaaaaatgtatgtgtatatgcatatgtgcatcatattcccaaagaactccatgacaaaaaaaaaaaaaaacaaaaacaaaaaacattaagcactctggactaaccttgcactagctggcatgtaaatgattccagtcaaggccagcatatagtgacaggtagtatcagatagtctgcgtgcatatgacccagatctagtgcctcccaggcaggtcatgcccttcaatcactgtcattcctctcccaacccacactgagccagctttccttttgccatctttcctgattccaaaaagagttaccatttgtattgccaccgccattatctcactttacaagataatttaccctgatccaagttgactgcagacacattgatgttttctttttaagaacttaacttgattttcatttttggttttaacagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaattttttggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacactcatacatagagagagattttcggtatgttgcaagtattttttccgattaaatttattttccaaagaaaaaatgatgtgttggtcatttattgctagtctgagttataaaactatggttaaatacatattggccaaatctgtaaactctcaaagccttatcctatttaagtataccaaaataattcacttttccaactgctgcggcattctgttttatggagaatggcagttaacacacacacacatggaaatctcatctgtagctcaatctgttagagtttggagggtggcagattctttacccaaagtgaatagttcatgtttattactctttattttccttgaaacagacaacttttcaaacagttctgaaagctgcaaaaatattttttacttttttaactataaaatcctaacctcacattatttcatgataatatcttgtgtattcttccacaagtaattttttttttaatttgaaaaaaaaaattgtcacccaggctggagtccaatggcgtgatctcagctcactggaacctcctcccgggttcgagcagttctccagcttcagcctcccgagtagctgggattacaggcgcctgccaccatgcctggctaatttttgtatttgtagtagagacagggtttcaccatgttggccaggctggtctcgaactcctgaccttaggtgatctgcccacctctgcctcccaaagtgctgggattacaggtgtgagccaccacaccctgcccttccacaagtattattaaatagatagctaaactcttgcagttgtcatgcacagaaatgttttctgagctgcagttttgattttttcttcattaaattaagtggggaaaataatacgcctgatttttctaatttcagaagaactctaaaactcttgttctgtttctaaaataaacttccagctaatttcattttctttggattatgaagagagagttctgcctttctgctttatggctgacagtgagcaccacactggactaagtacttgagaaggattataaagatgtgtgatgcaatgttgactcaggaggaatttatggtcttgaggaacaaatcatacctacatatatgaaatgactatgattacaaagcaaatacaagcaaaggcatgataatgtagtatgaactgttcataagattgccaagaagctctatacaaacttagtgaataaaaaactaaagggatcatcacatgggagagagactagtgatcaacagggatttggggaggttgtgagtctttttttttttttttttttgaaacagagtctcgttctgttgcccagcctggagtgcagagatgcaatcttggcttactgcaacctccacctcctggttcaagtgattctcgtgcctcagcctcctgagtggctgggactacaggcgcctgccaccatgcccagctaatgtttgtattttcttggtagagacggggtttcaccatgttggccaggctggtcttgaactcgtgacctcaggtgatccacctgcctcagcctcccaaagtgctgggattacaggcatgacccaccgcacccagccatgagtcttgaactaagttttgaaagaagttaagggatatgtattggtcacgaataggaaggcattgcaggttaaaggcagggcattgcagcatcacagagatggaagcaagcaaaagtgggtcagagcaagaaaagtggctttgtgcatttattcaataactgctaggcactacagacacagtggcacaaaaggcagataaggtccttgccttcaaggagcttacactctagtgagagtggcagtcaataaacaagtaaactaataaataatttaggtaatcatggactgtgatgttatgaaggtgcttatatagagggtgctttattagagaattatgtggaggtaaggggaatattttatttttggtttttgttttgagacaaggtctcgctctgtcgcctaggctggagtgcagtggcgcgatttcagcttactgcaacctctgtctccccggctgaagtcacaggggaatattttaaatcagggagccagagaaggccactctgacaggtgacatttgagatgagaccagaaggatgagaatgagccaactatgcaaagaaccagggagggctggtcaaagtgcagtggtgtttacaagtaattgaccacaatcagctacagatttctttgttccttcccactcccact[140 bp omitted]ggtgaaaccccgtctctactaaaaacgcaaaaattagctgggcctggtagcacacacctgtaatcccagctactcaggaggctgaggcaggagaatcccttgaacccgggaggcggaggttgcagtgagccgagattgcaccactgcactccagcctgggtgacagagcgagactccgtcaaaaaaaagaaagaaaggacagaaaggaaagaaagagagagagagaaagaaaggaaagaaaggaaagaaagaaaaaaaaggaaagaaaggaaaagagaaagaaagaaagaaagaaagaaagaaagaaagaaagaaagaaagaaagaaaaaggaagaaagaaagaaagaaagaaagaaagaaagaaagaaagaaagaaagaaagaaagaaagaaaggaaggaaagaaagaaagaaagaaagaaagaagagaaagaaaggagagaaagaacgagggagaagagcattcctggaaagaagagaaagaaagaaaggagagaaagaacgagggagaagagcattcctggcagagggaagaacaagcacagaagtgtggcagtgggaaagccttggtgaacagaaaggaggcgagggtagccagagtgtggtgagagagtgggatgagatgagattggagagagacagccaggtcttatgtggccatgtgggccagaacaagaagttaaattttattctaaatgctgtggggaggcattgaaggtttttaagcagaaaagcgatataatctgactttgatttttataagattactcagttgctgtgtggagaatggattggagggaagcaaggctgtgagtgagaagaccagttaagaagcgatttcggaagtccaagcaagaaaggatggcttggactagaatggtggcaataaagatggagaggaatgaatgagttcaagatgtattttgaaggtggactcagcatgatttgctgaaggattgaatatagggagttaaagaaaggagtcaagggtggcacctaggtttttggtttttgtttttctgagacaggatatcactctgctcccccaggctggagtgcagtggcgcagtggcgcaatctcggctcactgcaacttccgcctcccaggttcaagcaatcctcccacctcagcctcccaagtagctgggattataggcatgcaccaccacgcccagctaatttttgtattttttgtggacatgggatttcac[131 bp omitted]tagatgatcttgccatttgctgatgtgaggaagactgaggagggacagagttttggtggggaggaattcaaagttctgttttggacatgttaaattcaaaatgcccatgagacatgcaagtagagaagtagacagtgggctggagcacatgctgtctgtgtaattgtccaaaccagtcgtggtaagcagaataatggccctcaccaaagatgtccacaccttaacccccagaacctgtgagtatgttacctttcatgacaaaagagactttgcagatgtgattactgttacagacattgagatggagggattctcctggattcattgggtgggcccctaatcacaatccttaaaatcacaagtggggccaggcacggtggctcacggctataatcccagcactttgggcggccaaggcgggtggatcatttgaggtcaggggtttgagaccagcctggccaacatggtgaaaccccacctctactaaaaatacaaaaattagccgggtgtggtggcacacacctgtaattccagctactcaggaggctgaggcaggagcatcgcttgaacctgggaggtggaggttgcagtgagccaagatcacaccactacaatccagcctgggtgacagagtgagactttgtctcaaaaaaaagaaaaaaaaaaaatcacaagtggaagaggaagacagaagaatgggtcagggagatgcaaggatggaagaagaggcaggagaaatgaggcctgagaagaactggactcgccactgctggctttgaagacaaaggtttccaggtgccaagaaatgggtatggcctctagaagctgagcatgaccctcagctgacagccagcaaggaaacaaaggacttcagccctacagtcacaatgaactgaactcagccaagaacctgaataagcaagctaaccaattcacctctggagcctccagagaggcatgcaggcctgccgacacttcgattttggcccagtgagacccacgtcagacttgtgactacagaactacaagctaataaatttgtgttgtttaagccaatgcatttgtggtaatttgttatagcagccataggaaactagtatatcagaactttattgataattatttcaggataatagggacaagtctagagtgtggggaagagtgatgactggagataggaatttgggtgtcatcagcagatagatggcaagggactgagtaagagcagcaaaggagtggatgggaagaaacttctgggggagttggaagcaacaaaaactgacactcaggatggtggccaaagaaaggcctcaagggacgtgaggccgggcatggtgactcatgcctataatccccgcactttgggaggccgaggtgggtgaatctcttgaggtcaggagtttgagaccagcctggccaacatagtgaaaccccatctctacaaaaatacaaaaattacctgggtgtggtggcgggcacatgtaatcccagatacttgggagggtgaggcaggagaattgcttcagcccgggaggcggaggttgccgtgagttgagatcacaccactgcactccagcctgggcaacagagcaagactctgtctcaaaaaaaaaaaaaaaaagatgggacttgaaccaggcatgctgacttgaagccctagtacattctattgtgatgcaggtgcctctaatctaatcacagacaatgaggaggaaaaaaaacaagtataacaacaataggagactggagaagggatagacacggggaaagtcggggcaagttggggcaagtcgggaaaagtcgtgtactagcagaaagcaaaaataaattcttcagtcattcgtatctctcccttttgttgtcattgctagccaaaaataaaagtaatatccaaactaactgatatgatattcaggtccatttgacagctgttacttaggaactgtctaaaatattccaatggggccaggcacagtggctcatgcctgtaatctcagcactttgggaggccaaggtgggaggactgcttgagtccaaagagttcaagacaagcttgggcaacatagggagatcctgtctctacaaaaaaatttaagaattagccagaggtggtggcaggtgcctgtggtcccagctaatcgagaggctgaggtgggagggtcacttgagcccaggaggtcaaggatgtagtgacagtgagccatgatcacgccactgcactccagcctgggcgacagagtgaaaccttatctcaaaaataaatataaataaataaataaaatattacaataggatgatggaaacgaggggggtgtgtttgacatacagcaaagcacatatagctatagtagtcatcagaagataaataccacatattagatcctgaaataaatatttttgctcacatctctaaaaggaaacttgaaataaaatttcatgtactcattatgtttactttggaattagaagttatacatctttatcaaagatgaatctctgctccattttcaataagctcacctggggatcctgattgttataccaagctgcctgattttatatatatcaaattacatttaattatatagatgcgatatgtaatttttcccataaagttatttagtcttactcagactaaagttggagatccataaagcaaaatgtatatgtgcagggggtgttttgtgtaaatttaggggtataagtacaattttgttatatgactacattgcttagtagggaggtctcgtcttcatataaccatcacttgaataatgtacattttaccctgcacaggtttagaagctagtcacagcttataaaatttattaaaatatgtcaaatatttctaagttaaatttttctgagttaaattatttatatgcaattgggccatatgcagtggctcatgcctgtaatcccagcactttggaaggccgaggctggtggatcacttgaggtcaggagttcaagaccagcccagccaagatggtgaaaccccatctctactaaaaatacaaaaattagccaggcatggtggtgtgcgcctgtaatcccagctacctgggaggctgaggcaggagaatcgcttgaactcgggaggtggaggttgcagtgagccaagatcacaccactgtactccaggttgggcaacagagcaagacattatctcaaaaaaaatttatatacaattgcatttaaatggtaactaaccacccccattgggcaacatagggagaccctgtctctacaaaaaaatttgaaaattagccaggggtggtggcaggcacctgtggtcccagctaatcgagaggctgaggtgggagggtcacttgagcccaggaggtcaaggttgcagtgcctgatgtggaggaactggaactcttgtatcccgctgttgagaatgtaaaatggtataatcactctgggaaaaaacttgggcaggtcctcaaatggttcaacatagagttaacatgtgacccagtaattccactcctaggtgacaaccccagaaataaaaacatacgtccacacagaaacttgtataggaaagtttatagcagtgtcattcataataggcaaaaagtggaaatgagccaatgtccatcaaatgatgaataaacaaaatgtgggccaggcatggtggctcatgcctgtaatcccagcactttgggaggccaaggcgggtggatcacctgaggtccaggagtttgagaccagcctgaccaacatggtgaaaccctgtctctactaaaaatacaaaaattagccaggcatggtggtgcatgcctgtaatcccagctacttgggcagctgaggtaggagaatcgcttgaacccaggaggcagagttcacagtgagccaagattgtgccgttgcactccagcctgggcaacaagagcgaaactccatctcaaaaaaaaaaaaaaaaaaaaaaaaagtggcatatctgtacaatggaatactacttagcaacagaaagtaaataactattgatacgcacaacatgaatgaatctcaaagagtaacatgccaagtgagagaagctagaccccagaaagaagagtgcataatatatgatctcatttatacaaaattctaggaaatgcaaaattctaggaaactaatctatagtgacagaaagcagatcaaagtttgcttggggatggagagattacaaaggggcacaagaaaattttgtgtggtaatggatatgttcatgatcttaattgtgatggcttcacatgtgtatacatgtgaaaaaacttagcaaattgtgcactataaatatgtacagtcttattgtctgacaattacacctcaataagactgttgttttaagcagttacccatgggctggaatccaccaactgttgttttgttttgttttgttttgtttgagacagagtctcactctgtcacccatgctgtagtgcagcggtgcaatcacggctcaatgcaacctccacttccctggctcaggtgaccctcctgcctcagactcctgagtagctgtgactacaggcatgcaccaccatgcccagctaattgtttaattttttcgtagagatggggtttcaccctgttgccctggctggtcttaaactctgggctcacgatatcctcctgctttagcctcccaaagtgctgggattataggtgtgagccactatgcccagctgtatttttcttaaaattaataaaatctaacacatattaaatgctgttctatgcacatattatctcatttgcatgtgcctacagtcctctgaggtataggcactactatcattctcattttacacctgaagaaattgcagtttggagaggtaaagcaatttacccaagacctgacagctagcgaatggcagagccagaatttaaacttaagcaacctggttgcagggcccaccctcttaaccactgggctaaattacctttctcttcctatttgctccagattcccagacccagacgctcagatccactcactcttatagatacaaaaggatagagccacagaatcttagaattggaaagggtgtagaactctcttccagaccaacccagcgatctcccccatagcatccctaacaagtggctattctgcctcaacttttagccttcccagtaacaaaaagttcaccccatcgtatggcaacccattctacctttaagtatcgcatattttacaaactaatgtctttttgagctgaagtctaccttcatgaaacttctaccagcgggtttaattccatatagaatgtttaatttatgaagacagttatgatgtccttctttcacccaaagctctttcccagttaaatatctctcattcattcagccatttctcataatacatgatttatagacacttcactttcctgattgccttgtttgaatatgttccagtttgttaatgtcctcttaaatgtagcatccagaattaaatgtaaaactctatgggctggccaacagaaacccaagtggaactgaaagtccctctgatctggtcactaccattctcttagtgcaactcaagactcgttagtattttttggcattgtcaacccacagtgaactaggacctagttctctttttcacacatgctaccattaagctctatctcctcatccttaaatgtcttgcactaaatagggcattaaaaccctttattgcaatgcttcccattttataagcctgggtttattctggactttagcccttatgactcaattcctagaggtttgtgatattctttgggctttgtccttggaagcatagtcctccttctgtcatctatacatgcacttttaagatctgagctcatcagagaataatctataaggacactgtagtttattagaaatctctccctttttaatttatcattggaacttttccaaattctacagttctgaattttcaactggatccctctcccttttaagctatctttctcttttggtgttaggccagatcatacttatcttttctctgatccttttgaagtctaccttacacatacacatacatacaccgcacacacacacacacacacacacacacacacacacacacacacacgttaattaacctatgtgaccatgcccagcaattttttttttttttttttagtttttttgcttaacagatatccagatgacaggatcactttccccaagattcttgtcactttcactttgctaaccaaatcttccttatttattatcaggattaagcccagcttagcaatttacctcattgcttctttattcttttgagaactgtaattacactgtatcagcaagagagccaagaatctatcagatgttttcttaaatttaagatggtcttaaaaataagaaaaaagaatgtatcagatatgttgctatcagaataacttccagcagatattcagatgttctatgtctctgatcaccctttcctgttcgtctatgtgacagttttatgaaatgccattcatacttttatttattttatttattttttatttttatttttattttgagatggagtctcgctctgtcacccaggctggagtgcagcggcacgatgtgggttcactgcaacctctgcctcccgggttcaagcgattctcctgcctcagcctcctgagtagctaggattacaggcctgagtcaccgcacctggctgatttttgtatttttagtagagacggggttttaccatgttggccaggctgatctcaaactcctgaccgcaggtgatccacctgcctcggcctcccaaagtgctgggattataggcgtgagccaccgcgcccggccccattcatacttttaatctgagaagtctcttgtatacttctacaactataatcactttcatttctccgtttcattctcactgaatgcttttcaccctccagccaatgaattactagttataccttcttgacatattactgctctcttcttctgtatggtatctctgaatcaagttttccagatgccagccagaagttccaccctcccaagtctaaacaatacctataaaattgcattttcctgagtgtattaaaattttacattcccggccagtcgctgcggctcatgcctgtaatcccagcactttgggaggccaaagcaggcagatcacctgaggtcaggagtttgagagcagcctggccaacatggtaataacctgtctctactaaaaatacaaaaattagccaggcgtggtggtggcgtgcctgtaatcccagctactcaggaggctgaggctgaagaaccgcttgaacctaggaggtggaggttgcagtgagcggagatcgcgccattgcactccagcctgggcgacaagagcaaaactctgtctcaaaaaaaaaaaaattacattccctttattacccatattctgggtgttggtacatagatatctgaggccttaaaagtgtcatttctgactctcttccttgtttttccttgagaattactaggcattgccttagctttagttcctcttaattagacttatattttacatagcttccagaaacacaataattactaacacagcactatgtctcaatggaggaattagttttgattaactgaccagccatatatcattatcaacatcatcatcatcatcatcatcatcatcattaatattcttctcggctgggtgcagtggctcatacctgtaatcccagcaatttggaaggctaaggtgggaggatcacttgagcctaggagtttgaggctgcagtgagctatgatcgtgccgctgcactccagcctgggtgacagaatgagactctattttctattttcctggatgcttgctccttgtttctttttccttcttttttaaaaagtttttaaactttcagacttttttaaatgttgcaaaaatagtacaaaaatgtccttatatcctttattcaacttctctaaatcttacataaccaccataaccaagaatagtattggtaatctacagatattcaaacctcaccaatataaccaatgtcctttttctggtacaggagccggttgagtgtcatatattacattcagttgtcaagtatctttagtctcctttaatctgtgacagttccttagtctctttgtctttcatgatcttaacagtttcgagaatatctgactccttaaaatacacgcggtgataggtgactacgggagctccagctcaccgtggatttagcaaaataccaagtgatgacaagaagttgcttttaaatgacccatcttgtatttcatcgtcaataaaaccacacttagttacccaaagactgagaagggaaaaattctatgtaattatttgatcatctttttttgtggagagaaaaaaaactgacaaaacaatgagctctggaatagaatacagtagaggcatcatgctcaaagagagtagcagatgtggccagggaaaggtcacatgtagaaaagggatacacaagtgatggcgaggtgtatcgaggaataattaacagttgaataaaaatgcattaatcagaatgtcaagagttcaaactagaaagattttgaattttaaatgcattataaataaaatccacctctctccaaataaagccctctgtagaattttgctttagctcttgtttctctcaccagaatagagaagcgagtatcacctttggaggatatactctaccattctctgaaactgtttttttgcattcagctacctcgctattataatcagctgagaaacaccatagcctttcactaacacaggtcaaagatttctcccaggatcaacaaagctagattcaaaattgctcctttgaacacatgcaatttgtgtgcatcagtttcgatcgctggggttcttgaggagactaacaaattgcaaagtgtactttcagaggaagggcctaaccatcctggggggtcctagaattgggtcctttcacaggcagatctggagaagataggagagggcaggaaaggaaagtgaaggatatgaacactatgtgttcagtgtgcaaaggcctgctggcattttgcctatgggaattctgaagtctgggcacataaggttcagctgcagttgcagttttcaacagtcgtccttatttttataaacattgttatgattattcagacacggaacttgtgattacactatttgctcctgttctgaacttgagggagtccacttaagctaacaagtaggtttttgaggacatgtgtggcaaatgcttacccagtgaagggattaaggggctcagtaagcacttgtccattggcacaatggctgccaatctaattctattgattcctctaaatgtttctggagttcagaaatctattcaatccaagggcactttacctggggtcctgggagccaaatgttaacgtagttcttaaccttcctaagcctcttaaccttctgggtacaacctctatatttgtcttctggctaaaatcatttccccacccccagcccagtcctttggactctcccaggccaattcctggcaagatctttgtcgaactgtatttgcaaaccagggtctggggcacggtggcagttccttcgtctgctgttcccttaatttcgtctggtttcactggctccaggacagcacacggtctagagtgggaagagtgaggcattcaccttggtgaaaaacaactcagtaattaagacaaatgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggccatttgcttcgctccgccccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtacgtcctgggatccaggagcccaaccaggaagtggggggaagggtcgcacagaaggcgggcgcccgaggggtggcggggagcgaactctaaagacatggccagggaagcggcttaggagaggccagagcggggcgcagaggcagaacagaagtcaaactggtgggaggcgcctttagtgacctgaagtagtgagtctaggaaggggccgggggcagagggcaggaccaggctctcggcatctccgaggcggcggactcggatggagcagtttctgagtgacggcctccccgggcctgggcgtcaagggcgaaggccgaaagccggcgttagaaagaggaacgccagttcttaccgaagacctcaaggtcgcggcaaggagataactgcccgggggaggccatgcgcccgggtccagcggcctcccagcccgcggacgcgctcaaacctcgccgggccggaagccggcgccgggaagcgcgtgtgccttttacgtccgcccccgcgcagccgcggccgctgccgccgcgtctccgcctgcctccctgcgccgcgcgctctccagtgccggctctagagggcgctcctgggctagcgtgtagggctggcggcggcggcgctcgggtcacctctgggagcggagtgggggcggagcgagacggaagcagctcaggagacttgaggcgtaggctgcggtccccaaggtgaccgcgccctatgtgggactcgccctaatgcctctgaacctgggtttgaggtaatgacctttctcctaggtctgaaggtcacgggtccgctggaggatgccccctctccactcagaggggtggaggcttaatgctactggtgcagatcacctcttcccctgtgacagcctcagagggttgggagggtccagccagtatgatatacgaagactagatttgagagaggggagcctaccttaaagggcattgatcgagatggcataagctcttctctttcccttccccatggttataactgtccctgttggcttccttcctgtctgttaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggctctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggtaagtttgctgtgggctttaacgttgtgttcttaggagacagtttaaaagagcattgtaccaacctaacagtccaagagctaaagagttgtttttttaattgctaaaggaagccaagatcatccaatgcaacccttgtgtacagatgacgtgtttaggggatgtggggaaaggaagtcagtaaaactctgctttttggtaaaagcatctctttcctattcccaggaatgcttccggatcccaagaacactcacatcgtcatcagctggatgatcgcacagactgtcactgctgttgccgggttgacttcctatccatttgacactgttcgccgccgcatgatgatgcagtcagggcgcaaaggaagtaagttccacttgagcagaagataaagttgtagtcgtggggcaatctgctgccacaaactggtgatacatacctttaaaatggctgtctgtccaagtcaagggatggggttgatagcatctgtgtctgttccacaactgcctttgagctggcccttcagatgcctatgaatgagggtgcttaaatggtgttagaggttaagaccaatgggtagtctgtattcctgtggtcatagcattaatatttcagtgttgcccatgctaatgtgtgaatgttggatttaaagctgacgttcttagaggtggggctctgctttatttagcctagtgaatcttaggatttttcatcggccttcagtcactaactccatgtctttattctttgcagctgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaattttgtctgcagtatattttcatataaaaatgcatatttgagtgctacattcgaataaatactacctttttagtgaatgctacatttttaataaatgctacagtatctccggagatgaagaactgtctttttaaaaccaattgtcagcagtccgcttaacagaataacttggttgtgccacccacaaacatttccaacacattagcaaaggaattcaggcccagtgcatccaaaaaacattgttccattgcctatggatgatcatagctgaatgagctttctccaagaaatactgtgaacccaccttctctagtcctatggttattaatcatgagccatgagctgaattatccactttaaaatggttacgtttgttgcatgaatatcacctcatttaaacttttagaatc[131 bp omitted]actgcagcctccgcctcctgggttcaagcgattctcctgcttcagcctcccaagtagctgggactacaggtgtgtaccaccaagcctggctaatttttgtatttttagtagagacagtttcaccatgttggccaggatggtctagatctcttgacctcatgatccacccacctcggcctcccaaagtgctaggattataggcgtgagccactgtgcctggccagctagagcaa[135 bp omitted]acctccgcctcccaggttcacgccattctcctgcctcag[220 bp omitted]acacaatcttggctcactgcaacctcccccttccagtttcaagcgattctgcctc[134 bp omitted]gcctcccaaagtactgagattacagatgtgagtcaccacgcctggcctcaagccatttttaattccattcagagtagaggattagagctggcacagttacatagtgctgagattgcagtgctgttaaagattatgaagagggccagacattggccacgacctcaaaactaaccttacaaagaggaaatagcatctgccttttgcttcatgctaataagcccagtcaatggagggcatttatgtttattttcaataaacccttatttggaatccatgtgacagtgtttggactttctgtatctcttgattagggctcaaatccagtggattttgccatgagatttgtactaagaatgcagcattatgtctgtcaagccacaactttaaaaatgatagaacgggtgctccatgtgtacatgtaaagctcattcttgaggaatatcccacacactggcatgtataagagctattcacagagaggtctgcatggcatggatgaatgcccaaggatcccagagtttatgtttgtcctctggccaggcacctgaatcgtagtatagcttagttattaagaattctgttctggtatcaaagaggcctgggctgaagttctggactctgatgttcagttgtgttaggccaagttacttaatttttctaaaccttggttttccttatctgtaaaatgaggctattaataatgcctgcctcagagggttgttgcaaagattaaataatttatgccaagcatctaccatagaacataataagcattacataaatggtgactgacagttcttaggaggcagatttcaggggctctagaatcaatcagacatacctggattttaatcctggctctgctgattactgtgtgactttgggcaagtcacttaatccccgggagcctcagtttcctcgtctgtgaagtggggatataatagcgcttatatatttctttccttccttttttttttttttttttttttgacacggagtctcactctgtcgcccattcagagtagaggattagagctggtacagttacatagtgctgagattgcagtgctgttaaagactatgaaatctttaacagctggaatgcagtggtgcgagctcggctcactgcaacctccgcctcccaggttcaagcaattctcctgcctcagcctcccaagtagctgggattacaggcatgcaccaccatacctggttaatttttgtatttttagtagagatgggttttcgtcat[138 bp omitted]gcataagaaagcatgtagagccagaagtatggtgcctggcatttagcaagcactccgatgtgaactttcacataatacggcacccaggtttgttgagtgaagatttgcccaagtacagcactgcttaagaatgaattcaagctcacctttctttttctgcaacagactagatatactatattgtgtagcatttatacaaaataaacttcaggttagttctttttcagttgtagattttattcttgaaaggggataagaggctctccagtaagggctgcatacacgatgcaagaggagccaagccccctttatggttattacaatagatgtggactcactgagctggcagctattaaaataaacctaggaccaggcattaatgatcagaaagcaagaagtggtgcctcctgcaattgggtagctgacatagatgaggtgggggttttttttgttgttgttctttctattcttgttcaatgatttttgaaatttaatttaaagacaaagtggttttaatctctccaagctgtgcaggatagtgctatagaattcattatgtccattacgctcatgcgaacgttgatggtacacaatcttagcaacaccctaatttatgccgttgttttgttactattcaatacataacaggatccgtgaagcctgattccaggtgagagagccagaacacaggtcagcttgtgcacagccgtgcttcctattccaagggccctctgcactcagtgactggaagcagcgcgctacgggcgctccggaccgccggagaaagaaacgaggggtgtcttcccagagcggcagttttcgtgaatggtaagtcatttaaaccgtcatttttttgtatcaaaagagatgcagagatgctagagagtctattaatttgaaggcattttaaaaacataaactgcaaagagagttttggtatacaagggccatttctggcactgcccccagactccaattcagtctcctctatcattacagatactttgggagaaaaaatttttaaagtactgctgtactgtatcatagattttcaagcatccgtgttactggggtaaattctatttctcctttgaagtttgtgaacgtagtatttctaatttgcttttgaggtttttaatagttaacatctgtacatggtaataaaagccaaatagtaaagaaaatatgtaaaacgaaaagtaaacatcttcctgtcctgcgtttctcatcactagccccctcctcaaaagtcaccgttattagcaatttcttggctatccattcccccaaaattaatgcatattgctgtaacggctgctgatttgttttatcggaatcgtattctgaccacctggattcaaaatggcatgattcttttagaaccgagtcatactgtggagtaccaggactaacagaagctgtcggaggcaggagggcagggaaagggtagcttccggactctgagcaaggatttctaagtgtggccatttattaaaatcctaacctgggatttttttttttttttttttttttttttttttttgcgggggttggggggttagttttggttgctgagtgacctggagacaagtcacttctaacatcagggtcttagtttcttatccttgaatggagaaatttggggaagagacaaactctaaagtcccttctagtttagacgtcctccagctccatcatttttgcagaaagcagaaccagtgaaaggaccaggattaggtgatttaatcctttcagagaacattttaaaatatctaacacaatcgtaaatgaatagtctctgactcagagcagtcatttacagactgtgtgggtggtttgccattggcaagtaaaattacgaatgtaaagatttacattaatttcaggaccaagaagctgagcaacaaattacagctcggtgtttgggtcagaggtgctctgatttacctcaaaataattaacatctgtcttctcaaagcctcatcttattatgtgtaatgtgcacttccgtatgcaggttgagatttatttgaacaacaaatattaggcgctgcaatttcggacacaaaaatgccttgtgttccactccaaatgtttggaggagctttcctatcatttcagccattatttgctttatgtgcaggtgaacaaggtcagatgcatggtgctcttcttagccaaaggcttaagagagcctttggtatcccggcaacaaatataaacagtattcaagcgacagattgggcagttgctttcactagaccctcatcagagacaaaactgagttaaattaaaggagtctattaatccttggcttttccgtgactatcagggaaggggacagagaaacgagggggttatttttatggcgagcatccatcctgggatttcatttccttgggcaactttcgtaacatggggaggcaatttagcactgttgagattttagagaacatgccgaatctgatcacatgacatgttacactgtctctaatgttttcagtcccagaatagagatggttatggttgcaaggacataaccagaataaagtatcagttaaatagctgttgactggtaacttccgagggcctcgtgtttgggaatgaaaaggaaaactcttctgtctaaatgaactccaatacccagtttggcaagaagcagagatatcttatgggcagaggcaaaggcagatgtactgtggagctaggggtgcttcccctttggagccaccccttgcatgggcccctcccaagccctaaccatatattcatttggtcatatggtttggcaacattttcaaaagacatattttgtgtttttaaaaagagggagccaaatcatataagctgacacttccacaaaactcagatccattcctgcccgtggaactggagtggatgaaggaatttggaggcagccctgtacatcagggagaggtctggggcttcctcaccacctgaccttcctcggagcacaccgctcaggactcactcatgagaagctttgaggctagaggtctcattttcaaataccaaactttcttacttgacaacaattcaacttttacttaactgttttgtgccttagtttccccatgtggaatatggggataactttagtacctacctcataggaatagtgtgaagattaaaggagttaatatatgtaaagtgcttagaacaatgctgggcacctgctttacacaattttgctcttattatgactgttattgctttgtttttgtttttgagatagagtcttgctctgtcacccaggctggagttcagtggtgcgaacttggctcactgcaacctccaccccccaggttcaagcgattctcctgccttagtctcccgagtagctgggacaagaggtgcaagccaccacacctggctaatttttgtatttttagtagagatggggtttcaccatgttggccaggttggtctcgaactcctggcctcaagtgatccaaccgcctcagcctcccaaagtgctgggattacaggcaggagccactgcatctggcccgactgttattgttttattgaaatgctttaaattattttcacttcattcatgggagaatggtttaatggatttatccttttcctgcagattttctaaaacagtctcaagaaaatgctatatatactatagaaagtggatcacacacacacacacagagagagagagagaaggttgtaaagaaagaaaaggacatttttggaatggactgaatgaatagaaacatgtgcttatggtgataatcctgagctctaactcagagcacttattttacaacactgattatgaaagagaccaaaggtcaaagataaatccgtcctgcctcacaaccagactgcactgctcacctgacccaggggccactgtgtggtcaccaggattcttctcacagcttcctttgctctcgtagtatttcaaggaacccatgaggtcccagcctgattacccaaccctatgacttcactccctagggaaagaagctgcagggaggagaaaatttactgagacctttagaagcaaaggatctcctttcactttcacaactaagtccagggttcaggagtccatttattacaaaaattgagcttcataatggctttatcccagaagtgaagatcagggggtaaggacgcttgggcttctgggtaaaagcgtgctgtttgccaattagggtagaaagctaggagtttgaccactgaaattgtaatcccacttcggctccatgtttctttgtcttgggtcatatcacatcccgtcactagttagtggctcagtttgtctaccaggaaacctggaaatcaactttcctttttaagctacaatataattcctcaaatctactgtgggctgtggttctttttggagtttctagggctagatagattgaattaagttaagcctgcgtcttcaggttaaacaatcgatacaaccaggtaacagtaatttctctaaaactacagaatcaagatcatagctcattattttgacatcttatatgccagatgttgtgctaagcactttacatggattaactgtccctattgtctcaacagccctaagaggcaggtattattattcactccatttcacagctatgaaaccgaagcttagagagatgagataatgtcctctgagctatctgactcggcaaaaggtttcaaagagaacttcaaggtgaccctgtccaactatttattttgggtcatgaactatattaaaatatgaaagccggctagtttcaataccaactgacaaaatccatttgacaaatattaaatagaaattataataacctcagttggataaaaaaagagataacaaaagaaaaaataaattataataaccaaagcactgtttgtaaagtccatttttagagtatgggttattttctattttcagccaatttaagaattatggtcattaaaaactacttgaccctaaagctctagagttaaatttgaatttattcacatttctttggcttttccaagacagatcttccttttaaatgacggctcttcacaaggaatactgagcctctctctaaggttacaagcctgaggctggggtcattaggactttgcgtaaggcccataccaactaacaaccacaggaggagttggtgttggccgcaccct[133 bp omitted]caacgtggtgaaaccccgtctttgctaaaaatacaaaaattagctgagtgtggtagcgggcacccgtaatcccagctactcaggaggctgaggcaggagaatcgcttgaacccgggaggcggaggctgcagtgagctgagatcgcaccattgcacttcagcctgggt[137 bp omitted]gtggcaggtgcctgtagtcccagttacttgggaggctgagg[139 bp omitted]ggctttgggctattttatctgattgcaccttatattgagagacagtactgtgcgcctcatgttctgttcctcctcctgcacgtgatctgcagttccacttgccatttcctacctatgtcattcactttcatatttccaagcttggctgtactattgtttttcccagcatgcccttacctgcccctctgccagggcatgatccttcaagacccagctcagattgcaccacctctgggagccttcccagactccacctgcccatactcattgctctctcctctgtacttctaaagtaatctatctctgtcagcttcacaaaggcagatattttgtctgtttcattcatgtgtccccagtgtctagaacagtgcctggcacatagtagatgttcaagaaatagttgttaagtgaatgaattataatgtttatttcatggtatcacaaccaagtatttatttgtctgtcctcattaagggctatgtctcgtttctctttacattcctaaaactgagcatagaacctaacacatagtgaatgtgtggtaaatgtttgctgaaggaggagataaatgagaaaatgggccaagtgcagtggctcacacctgtcatcccaccactttgggaggccgaggcgggtgggtcatttgaggtcaggagtttgagactagcttggccaacatggtgaaacaccgtaactactaaaaatacaaaaaattagctgggtgtggtggcacatgcctgtagtcccagctactcaggaggctgaggccggagaatcgcttgagcccgggaggtggaagttgcagtgagctgagatcgcaccactgcactccagccagggcgacagagactctatctctaaataaataaataaataaataaataaataaataaataaataaataaaatagccaggcacagtggctcatgcctataatcccagcactttgggaggccgaggcagtcgaatcacttgagattgggagtttgagaccagcctggccaacatagtgaaacccaatctctactaaaaatacaaaaattagctaggtgtggtggcgggcactgtagtcccagctactcgggaggctgaggcaggagaatggcttgaacccgggaggtgtaggttgcagtgagccgagatcgagccattgcactccagcctgggtgacagagagagaccctgtctcaaaaataaataaataaatatctgtataacgaaataaatagagaatgaatgaatggcatgttgtagggtttgtgcattggttattgattggcatgaatgaattttggctcgatccagccacttgatacctgggaacaattctgtagcaataaatgtacagggcctttctttttcattttcttacataataattcagcaaatgtccggggccttttgacttgcagctattgtttttccagaccctgggcttacagggaagatctggatattgcaggggttgggaaatcaactggttcctgtactgctgctatgttgtccatgctagagaaccagagaggcgggaccttggcacacacccctcccctcctgaaatctgtgtgaaaaacagctgactccacatccagggcttctaccatactgtgttcatgggatgctggcctgtgccacacatgtgctggccatcttgtcatgagcccctaacacagagccctccacatagtaattgcctgatggatgtctggttgtgatgatgacaatattgaacagtggctgtcacacaacatgactcaggccactccaaggggagaggaacagacatgttcctggggcacctgaggacgctgccgatagagctgtgccaactgcacgcccatgtgactgattagggctgattaggccagacctgctcccagacctgggcctaatgttcccagcttctaagactatttcagccactaaaagcccatgagaacccttgagtgaatgtggccctttttgacgtgctcaggaagcaggcagagtttgttctctctcacttgtgagtgggaggcctccaggagtgcagcagcggacttgctcagtagtaacatccattgtcatttcttgagctttgactatgggccaggcactcttttaattgtggatactcatttaatcctttcagtggccttatgatgcaggtgctaagattaccatttcccagatgaggaaaccgaggcacctggcaaaccacgtgtaacacctgcagatgaaaaccctgaaaacaaagggaacccccccccaacttagagagagtcagaaagtagcacttaatgctgcggtgcctggaaaataaccacggaggcccagaggaagggaggggttcaagctctttagggaccatcggcctgcttggggacctacccatgtgaggagcccctggagaggcgcttggtgcagtggttaagagcatggttccgcccctttccagctgtgaaatggtgagcaagattctaagtctcactgcctcaccttgctcagccggaaaatggggtcaagaacactacttgcctggcactgtagtgaggatgaaataaattaatatttgcgaggcgcttggcacaaagcctagcatataatatgcgcttaagtgtttgttaaataactacgggctctctcagagtcggccccttccctttaggcgccggttttgtaatctgggaaactttgtaaagagcgctctcagcgcggtggctaaaacagtccgctaggactatgccgagtagcagcagaaggaaatggcccggcccgccaggcggggagctgcagacaactaggagagaggagggcagggcacgccctgagggaaaaaacgcggcttttgcaggcctaatggcggttgaaagtcgccgaagtgcaaggctggattgagacagacaggctgaaaaagtcgcagcgcagccgcagcggcagcagccgatggccgactccttccttttccagtccacgtgcccaggcgggtctccggccgcctctcgcacctgcctgcagagggcgcgctgcttctcgcctcggcctgggcaccgcggccgactccgctggaagagctgtgtcctccacgcagaccgctttccaccaagctcagctaaacccaccgcccccaagaagtctaccctggccgctccagccaagctcttcctcccctgaacccccaaagcatcatcagcactgcataatttagaacttggatatgtgctggctggtcactgtgtcctacgtatgggacaaatcttggctcaacaatatcatactttgcatttctcccccgagtcacacacggccattggcataccggcagccacatagcgtgtgcccagcaaacacctggtgtacctctactgggtctcactgtattggctcccaaaggagactctcaggatccctgatgtcgccaagccctggggtggcagaagggacacctgggaggatgcctgcatggcctcagttgccacttcgagccttcactgaccaaatgaggtcggtgtagcccacctcagaaggcaatgccttcgtgcaaaggaaaccctctgccagggaatccattgatatggaaatatttgctgagccccagctttggtgcagagccctgtgctgggcaccagggacacagtgaggaatagaaaggattcttgtggtgatgggaggcagtgtagaaaaattagaatagcaagagatttaaagtcaggctgggcgcggtggctcacgccggtaatcccaacactttgggaggccaaggtgggtggattatttgaggtctggagttcgagaccagcttgaccaacaaggtaaaatcctgtctctactaaaaaaaaaaaaaaaaaaaaaaaaattagcagggcgtggtggcgcatgcctgtagtctcagctacttgggaggctgaggcaggagaattgcttgaaccccgggaagtggaggttgcagtaagccaagattgcaccactgcactccagcctgggcgactgagtgagactccgtctcaaaaaagaaaaaaaacagagagagatttagaatcagaaaatcccccacaggcactagctgtgtggccttgggcacaccatgtcacttctttgagtctcagtttcctcttctgtatctctgagggagtctggagtagggtagcggtggtcagatctacaatgatagccagatttataatgttttaatgttcatgagaacatacttatccatgaagtaagtaatttaaattacatttttaacagtacacattttttttttttttttttagatagaatctcgctctgttgcccaggctggagtgcagtggtgccatctcggctcactgcaacctccaccttctgggttcaagcgattctccagcctcagcctcatgagtagctgggattacaggcgctcaccaccacacccagctaattttgtatttttagtagagatggggtttcaccaggttggccaggatggcctcgaactcctgacctcaagtgatccacctacctcagcctcccaaagtgctgggattacaggcatgagccactgcacccagctttattccttcgatttagctgtaactttgtaaccaacctctccctatcctcccctcccctctacctttcccagcctctaataatcataattctactctctacttctatgagctcaggagttttttttagctcccacatataagtgagaacatgcagaacatgcctgacttatttcacttaacataatgtcctccaggctcatccatcttgtcatgaatgacaagatctcattcttttttatggctgaataatattctgctgtgtctgtgtgacattttctctatccattcatccattgatggacactaagatagattccatatcttagctattgtaaatagtgctgcaataaacatggggaggcaggtatctcaatacactgatttcctttttgggggtatatatccagtagtgagtggaattgctggatcatatggtagtcctatttgtagtttgtttttttttttttaagaaaccttcataccattttccataatggctgtactgatttacattctcatcaacaatgtacaagtccccttttctctgcatcctccctagcatttttttttttttgtctttttgacaatagctattctagctggggtatacattatatttttttaaattgaagcataaaatggaagtgatggtgttttgtgaaaaccaaatgataaaatagttatgaaagctgttgtaactgaaagaggcaccacaaagtttcattatgtttaccactgctaaaatatataggaggcacccagttaatgtttcttgaggagaatggaaatgtttcctgagtgataggatccatatataaacatgagagttaagagtgccagaacatctgacatgtgccaaatgcgctgtccagatgataagtatttaatggattctcttagagagcaatcactgggcggggtggtcagggctgcatggtggaggtgagatttcagttgggccctgatgatggcgttgatctttggtgaagaggcatgaggaagacaatccagacagagggaagggcatgcactaagggcacaaaagcaggaaggtatgaatgatcgagaatgccaagtgcaggagggcagggccctctgcctctgctctagcctcagtgcctagcacagtccctgacacatagtaggctctcaatacatgtttgtggaaggaagggagggagggaggaaagaaggaaggaagagaggaaggaaggaaggaaggaaggaaaggaaaggaagggcggaagggtgggccaggtgtggtggcttaccactataatcccagcattttgggaggccaagatgcgaggatcacttgagcataggaatttgagaccagcctggccgacacggtgaaaccctgtctctactaaaaatgcaaaaattagctgggtatggtggtgggtgcctgtaatctcagctactcgggaggctgaggcaggagagtcgcttgaacccaggaggtggaggatgcagtgagctgagatcacaccactgcaccccagcctgggcgacagagggaaactccatctcaaaaaaacaaacaacagcagcagcaacaacaaaaattagctgggcgtggtggtgcatgcctgtagtcccagctactcaagaggctgagacaggagaatcgcttgaacccaggaggtggaagttgcagtgagccgagatcgcaccactgcacaccagcctgggcgacagagcaagactccctctccaaaaaaacagattacatgatacaatgtgagtaaagagcctgctgcaaccctcaaggacaattggtggccattgtgatcacaccccttaggctgaagcagatttcggaggagtgctttgcatacagtaggtcatcagctaatacgggttgactgagaggaagtttggggccttgaaccttttatccgtgtaggcaatggggagcttcgcacacaaagtagggtgggtgttggacgatgaacacagatgtggacaatgggttagacaatcaacacagatgtggtgtgaggtgtgggttgaagtggaggaggaggagacacaggtatcgcagttgttgcaacagcaaagggattagtgacaggctagggtgatggcaatggggatgaaaggacaggtagggcagagaaagcaaataacagaacttgttttttgttgttgtttttgagacagagtctcgttctgttgcccaggctggagtgcaatggcgcagtcttggctcactgcaacctctgcctcctgggttcaagcgattctcctgcctcagcctcttgatgtgtccggaattggtgggttcttggtctcactgacttcaagaatgaagccgcagaccctcgcggtgagtgttacagctcttaaggtggcgcgtctggagtctgtcccttctgatgctcagatgtgttcgaagttttatccttctggtgggttcgtggtctcgctggctcaggagtgaagctgcagactctcgcggtgactgttacagctcttaaggcagcgcgtctggagttgtttgctcctcctggtagcctcgtggtctcactgggctcaggagtgaagctgcagatctttacagtgagtgttacagctcataaaaacagtgtgcacccagagtaagcaataacaggatttattgcaaagagcgaaaaaacaaaccttccacaccatggaaggagaccggagcgggttgccaatgctggctgggcagcctgcttttattctcttatctggcccccacccacatcctgctgattggtagagcccagtggcctgttttgtcagggcactgattggtgcgtttacaatccctgagctagatacaaaggttctccaggtccccatcagattagttagatacagagtttggacacacaggttctccaaggccccaccagagcagctagatacagagtgtcaattggtgcattcacaaaccttgagctaaacacagggtgctgattggtgtgtttacaaaccttgagctagatacagagtgccgattggtgtatttacaatccctgagctagacataaaggttctccaaggccccaccagagcagctagctacagagtgtcgattggtgcactcacaaaccttgaactaaacacagagtgctgattggtgtatttacaatccctgagctagacataaagattctccactgtccccaccagagcagctagatacagagtgttgattggtgcactcacaaaccttgagctaaacacagggtgctgattggtgtatttgcaatccctgagctagacataaaggttcttcaaggccccaccagagcagctagatacagagtgtggattggtgcactcacaaaccttgagctaaacacagggtgctgattggtgtatttacaatccctgagcgagacataaagacgtccccaccagactcaggagcccaactggtttcacctagtggatcccacactggggctgcaggtggagctgcctgccagtcccgcgccgtgcgcccgcagtcctcagcccttgggtggtcgatgggactgggcgccgtggagcagggtgtggtgctcgttggggaggcttgggccgcacaggagcccatggagtgggtgggaggctcaggcatggagagctgcaggtcccgagccctgccctacgggaagacagctaaggctcggtgagaaatcgagcgcagtgccggtgggccggcactgctgggggacccagtacactctccgcagccactggcccgggtgctaagtccctcattccccagggccggcagggctggccggctgctccgagtgcggggcccgccaagcccacgcccacccggaactccagctggcccgcaagcgcctcatgcatccccggttcctgctcgcgcctctccctccacacctccctgcaagctgagggagccggctctgcccttggccagcccagaaaggggctcccacaatgcagtggtgggctgaagggctcctcaagtgccgccaaagtgggagcccaggcagaggaggcgccgagagcgagcgagggctgtgaggactgccagcacgctgtcacctctcactgagtagctgggattcgattacaggtgcgtgccaccacacccggctaatttttgtatttttagtacagat[150 bp omitted]ttagaaaagagaaataggtattaactcagaaagatgcagagacctgctacgtgtgttttactgccaaaaagcacagagctgagcctgtctaccacctcctgtcaaagtgtaaaataacccggaagactcacagggggttctgctggccctggtcagtgaaagttggaatggccagttcccagacgctgcaaattttttgggcaataacattttcccaggaattttagagactgccggattttttttttttttccttctcttccttcaaattgtcaggacagcaccgtccacaagggggcagattatatctggcaaagtccaattacgatggcaatactagtgatattaaaaggcaatctcctggccgggcgctgtggctcatgcctgttatcccagcactttgggagtccaaagtgggcagatcacttgagatcaggagttcaagaccggcctggccaatatggtgaaaccccatctctactaaaaatagaaaaattagccgggtgtggtggcaggcgcctgtaatcccagctactcgggaggctgaggcagaagaatggcttgaacccgagagaatggcttgaacccgggaggcggaggttgcagtgagccgagatcgttccattgcactctagcctgggcgtcgcagcgagactccatctcagaaaaataaaaaataaaggcaatctcccctcataggtgcttcagctatctgaacaagcacaaagaggatatcaatgccatccatttcccctgccctattagcaggagctgcaacgtcagaggtgtgcgtgttgccatatggcaatgaggcgagctctgggaagccaaagagcccttacccgactacaggggacattggttattggccaaacttgacacttcctcctgcttctagctcctggacacctcaccattttcatctccctaacagggccaggaaacagcagagtgtgaggcccagtgggcctgatggtgctaggaagacccctgcaaactgagatcagttgggcaagtgcccactgcaagctgagcccaggattgggtgtggggaggtggaaatccaggagaaatcaaagactccttcaccaaacccaatctgatggaagagaaaaggcaagcccacattggttcagagatcacagagacctgggttcagatctcgatcccatcacttcttagcactatgtcataagtcaggctgctgaacttcctgaacctcagttacctcatctgtaaaatggggagggcaaaaacagtatccacctcacagggtggttgtggggtttcagtgagatattgcataaatgagatagagcctggctcacaggtagtgctcagtaaatggtagctggaatccatgttattgttccagtaacaataaagcaatgtggtaccattgactatactgagtacagaaaaaccttggaagacacaagtggcaggtgagtagaaagtgggtttttccctgactgattgaaggtgaaggggcaggaggtgtgagaacggagcagggagggcattccagaaagagggaaagacaggatgtcttcagggctggtcccatgggtctgcatcggcaaggatggaggctgctgtgatggggctgagtggtttcaggcccagcccagccaggtacaggcagctgctcag[134 bp omitted]tggccaacatggtgaaactccatctctacaaaaaatacaaaaattagctgggcatggtggcaggtgcctgtaatcccagctacttgggaggcagaggcaggagaattgcttgaacccgggaggtgtaggttgcagtgagccgagatcatgacactgcacttcagcttgggtgacagagcgagactcggtctcaaaaacaaaagtaaaaacaaagaagtaatatgagggaaagagtgtctcggatgattgttagagaagtctcttggtctccagccacagcattttagaagaggaaggcaaatctatgacagcaagctaaggaagatgaggcccaatctccctctgcaggtgcagagaagccaataatatgggataagcgactctggaagtttctttcttctgggcctgaacatatgtctagaattccaagaacatgacccgatgggacccagaagccagcccacaaaaccctcagctatcaactacaaaatgctcatcccgggcatttgtccccccaccacccccaaactccccaccccagggacagtaaactggaaggctattcttgacatttctgatctcagagcccggtctaaggttttcatttccatgctgggttttgtttttttgtttgtttgtttgtttagacagagtcttgctctgtcacccaggccagagtgcagtggcgctatctcagctcactacaacctcaacctcccgggttcaagcgattctcctgctcccaagtagctgggactacaggcacacacaaccatacccagctacatttttgtatttttagtagagacagggttttgccatgttggccaggctggtctcgaactcctgacctcaagtgatctgcccacctcagcttcccaaagtgttgggattacaggtgtgtgccaccgcacctggcccatcctggttctataagtttaacttcccccgtgagtagatctttttagggcgctgacagagccagcagagctgggctcatttcctgtttgcccagatgctaagcttccatataacccttggttacacaggcccttggaaggaagccttggcctaaatagccccaaacaagtgataatagaaaagccttttatatttagcttttggatattgtaagtgatttttggcagcatatttctcttcctaaatagagctggattgggctaattaaaattaactttatgggatgcagaataggagagtggttaagagcctttatagaccagtggtatgggcgctcagccacacagtctggttttcagtccaatcaccaccatttgctagctgtttatctccctgagtttcttcatctgcaaaacacagatatagccagaatacctttctcattgggtatctgtgaggattgcatgaagactaatacatataacacagcctgatgtctggcccctggaagcattcaataaagggtggcagtcatagttatcatgacattatttccctagtagacccactgggctttggataaaggaagtctaaaggtagcctgggggaggggtatatgagggaaaatcaggccaggattaaaaactgtcagcataggcccggcacggtagctctcatctgtaatcgtaccactttgggaggcagaggcaggtggatcagttgaggtcagcagtttgagactagcctggccaacatggcaaaaccctgtctctactaaaaaatacacaaattagccaaatgttgtggcaggtgcctgtagtcccagctacttgggaggctgaggcagaagaattgtttgaacccgggaggcaaaggttgccgtgagccaagatcgtgcctgggtgacagagtgagactctgtctcgcaataaataaataaatacatacataataataataaattgtcagcctataatccagaaaaaaacaatccacctgtggataatcgagttatccacttcttattctttttttttttttttttgaaacagggtctcactgttgcccaggctagagtgcagtggtgtgatcagagctcactgcggtgttgaactcctggcctcaagtgatcctcctgcctcagtttcccaaagtgttgggattacaggagtgagccaccactcaacggccagaacgtgatttcttgaccctttttctcaggattgtgctagctcctcagcaggtttaggctagagtgagcaggtggcattgccccaagaccagttggatgcagagtctgtcaggaatcacttctctatgcaagggagtaggtctggctaggcacaggtatgtgcttgcaaggtaaatagttgttactgacacagtcacctttgtctgtgaggggaggaggaggccaatgcctatggaaggacaaaactccttcagccttaggcaggtcttacctgcccctgcattcttgtcaggttatatattgctcttgtgatgtgtttggaaaaagacaagaaaacatacttttttttttttcttctagccaggacctctggctagaggtagagggacttcttagacgtcactatcatggctgaagcctcaattctgtcctaagccaggaaaccaaattggtaaatttggtctttttttttttttgacagggtctcactcctgtctcccaggctggagtgcagtggcacaatctcaactcactgcagcctcgatagcccaggctcaagtgatcctcccacctcagcccctcaagtagctggaattacaggcatgagctaccacggccggctaatttttgtatttttagtagagacagggtttctccatgttggccaggctggtctcgaactcctgacctcaggcgatctgccggcctgggcctccaaagtgctgggattacaggcgtgagccatcatgcctgggctagtaaattcagtctttatatcatggttcctccattgttgtcaataactctagcactgtgaacatgcttttgtgagctgatgctgctatttacttctctatttacacatttacgtatttgtgtctccctgataccacatttatcttttgaatgggtaatatattggtaatatatcctcggataccaaattgacaaggtataaagggtttacagtaacaagttagtttccctcccacccctgttccctcgccacccacaggtaatctccatgaccacattctggtgttaccttccagagataagctatgcctatccaggcatctattattttaggtggtagcattcttactcatatttgtatcccagtgcgtagaggagtgccaaacaaaagtatgctgtcaaaaaaagcttgttggttgcatgtttgttgctccagatttgttgccctcatcccagccatgggtgcctgaactctctagttgaaattttcatgagcttatcaaaattttacctggggccaagcgcggtggctcatgcctctaatcccagcactttgggaggccgaggcaggcggatcacgaggtcaggagttcgagactagcctggccaacatggtgaaacctcgtctctactaaaattacaaaaaaaattagctgggcgttgtggcgggtgcctgtaatcccagctacttgagaggctgaggcaaggagaatcgcttgaagctgggaggcagaggttacagtgagctgagattgcgccattgcactccagcccaggcaagagtgtgagactccgtctcaaaaaaaaaaaaaaaatttttttttttttttttttacctgtttggacttgcagctctggctttattttctccagactgaaatttacaaagaagctactggggccttgcctaatataaacaagttattctccttcacaatagaactctaaagagcaccctgatgcatgaattttcttccctgctctgttcagtgtaaaacagaagcttagccccagctcctctttgttaggtgactgttccctgaggcaagggttaaagagactttgatgctgctcatcttaggggagtctctaagcatactcatctcagaattctggctcaggaaataaaatgcaggagtttccactgcagtattcctcagtccttgacagagctgggttttccagaagcatccagacagcagtgccaccttcatattctctcatattctctctctctctctctctctcacacacacacacacacacacattttttttctccctgatgtggctaggggacaggctggactcctgcacttgatccatataaaagaacctaaggaagaaagaaaaagggaggagtaagagggccactccctgtcctgttctatgatcacgaggcttgtaaactcaaggaggcagcagggcagagtgccgaagcaaacagaggctgcctgggctggaatcctgactctgccatttatcgcctgtgtgactttgaaaccacctttgcaaaattataactgaggaagttatgatagtgaaagaaaacagacctaaccgattccatcttgcttctaacctttaagctgtccttgttcattcctgggcataggccgaactctccattgcaattcccctgtcttgataaatcgtctctatctaggcagtgagcaaggtgaacccactgggtggttacaactttggacaagttatttaacctctgtctgcttccatttcttccaccgtaaaatggggataactgtacctactttaaaagacttgttatgaggattcagtgagttaacagattgcaatgcatttagaacggtgcctgggcatgtggtaagtgcaatatacatgctatttatttatttattgtttttattttattttatttttgagacggagtctcactctgtggcccagggtggagtgcaatggcgcgatctcggctcactgcaacctctacctcctgggttcaagcaattctcctgcctcaccccccaagtagctgggactacaggtgcccaccaccatgcccagctaatttttgcatttttagtaggcacagggtttcaccatgttggccaagctgacctcaaactcctgacctcaggtgatctacctgtcttggccccctaaattgctgggattacaggcgtgagccactgcaccccgcctatacatgctttttaaacaaaaagaaaaacgtccatgtcagtggttcccgtgttcgatgcatgtccctctattccctggctgtaagtttcaaggttttcacttaccgatcttgggccctttggtgcattttttttcctattgggaaaaagctaaatgttgtgttgtatggtgcatttcttacacagaaaggaaaaactaaaaaatagcctgtatctaggctaaaattcctgtatagaggcaagattgtgtcatctaaagttcttactacattgactttttcctgatgctgttcttggggcccccactctgcctctagagggctggtaagagtccacaggagagcttcccaagccagtgccttttaggaagagttgctgtggctactgagctgatcaaaggtctcagcctccacaaagaagcatgtgctgctgtggcaatgggcctgagggtacgggggccccagggttgcagggcaagacaacaatccggaatccagctgttgtctcggccatcatctgaggtcatcctgccagattggcaggctgtgccctagaccacagaggtagcccctgctcttcaaagggctggattgtcagcccagcccctcctaggccttctcttcaggcttcttctttctacattatcccaacacaaacagcttgacttccaagtgacattgcaccagaaagacttccaaagtcagctcacctatcctagggatctagcccggccaggggctcctatgagggattccataggaggagtcagagactgtcatctaggaaggcttcagagcttcaggataggtcctgggcaacccttgatcgccctcagagactcactcaggttttggcgtccctcggttacagaaaccctcatgaccctaatcacattgcaactgcatttccttcctgtgcctcgggctcagtcagggttgggcccaggtgtgccagaacagcaggcgttcaaaaagcacatcgcttgcttctcagatcttgctcacaaacagttttgtgcagttctatggaaaggaaaaaaaaaaagtgtacccttaacaaccaatatacacatacagactcattcagtgaacatttgttgagtgtctgttatgaacaaggtcctgtaccaagtaccaaggggaggggaagaggatgcaaagttgacttaagcatagtcctttcccttaaggactttgtcctctgccagagaagccagtcacacatatataaatggaattagtttattagtttaataaagtggaattaaaacaagctgtaacataagaccaaactatttattgacttgacatttgctgaacagatattgtgggccaggcactgtactaggagcaagggatacacagcagagaagaagagagaaaaaatcctacccttatggagcttatatcccagtgaaggaggcagagaagtaagaattacaatatagtgtgacaagagtgttaagaggggtcagcagactgagatttgggagcaaagaaggaagaatgtttaactaactgacatttggggaatctggaaacacttccgagagaaagctccatctcggccgggcgcggtggctcacacctgtaatcccagcactttgggaagccgaagtgggcagatcacttgaggccaggagttcgagaccagcctgggcaacatggcaaaaccctgtctctactaaaaatacagaaattagctgggtgtggtggcacacacctgtaatcccagctactcggggagctgaggcaggagaattccttgaacccaggaagcagaggtggcagtgagtcaagatctcactactgcactccagcctggttgacagagcaagattgtgtctcaagaaaaaaaggaagtgccatctcaaccacagctgccatgtggcatggctacagtgtgaatgttgtgcattaccaattgtaacagcccaggctgaaggataaataggagttagccaatagtacttagcaggtgtggagaaccaaaagtggttcaaaatggctagagtgcaagggccatctggcaaatgtggatggagggagcatgagagttggaaacacatcattttgcaaatatcattataaagattggatgggccagatgtggtggctcacgcctgtaatcccaaccctttaggaagcttaggtgggaggatcacttgaggccaggggttcaagaccagcctgggcaacacagcgagaccctgtctctacaaaaaattaagaagataagctgggcacggtggtgcaagcctatagtcttagctactcaggaggctgaggtgggaagatcacttgagaccaggagtttgaggctccagtgagctatgatcgtgccactgcactccatcctggggtacagaatgagaccctgtctcaaaaagaaaaaaatatcggatgaaacacaacatgccaaaatctgtgggatacagtaagagcagtactaagaggaaagtttgtaccaataagcaactatatcaagaaaatataatgatttcaaataaacaacccaacaatgcacctcaaaaaactagaaaagtggctgggcgcagtggctcacacctgtaatcccagtactttgggaggccgagacgggcagatcaggtcaggagattaagaccatcctggctaacgcggtgaaaccccgtctctactaaaaaaaatacaaaaaattagccggacgtggtggcgggcgcctgtagtcccagctacttgggaggctgaggcaggagaatggtgtgaacccgggaggtggagattgcagtgagccgagatcgtgccactgcactccagcctcggcgacagagcgagactctgtctcaaaacaaaacaaaacaaaacaaaacaaaaactagaaaagcaagaacaaaccaaacccaaaattagtagaaggaaagaagtaataaaggccagagcagaaataaatacaattgagacttaaaaaaatatacaagatcaatgaaatgaaaagtcagttttccactaaagaacttatccatgtaaccaaaaaacaacctgtaccccagaaaactactgaagttttttttaagttggtttttgaaaagatttaaagaaacaacaggccggggcgtggtggctcatgcttgtaatccaagcactttgggaggccgaggtgggcggatcacctgaggtcaggagctcgagaccagcctgacccacgtggtgaaaccccatctctactaaaaataaaataaaaataaaaattagccgggcagtagtggtgcgcgcctgtaatcccagctccactcgggaggctgaggcaggagaatcgcttgagcccaggaggtggaggttgcagtgagccaagatcatgccatctaaaaaaaatgctgcgggaatgttctttagaacatttttttcctctcaagtacaggagctactctagggtcaggtattgcatttagcttttttaaaaatctggaacaggatatctctattcttaggaaatatacactgaagtgtagaggtaaaggaccatgatatatacaacttattctcaaatggttcagaaaaagtgtgtgtgtttatagtatgcatataaaatgtatatacataatgtgtatatattatgtgtatgtgtatatgtgtatatatagtgtgtatgtataaaatgtatatacataatatgtgtgtgtatctgtatggagagagaaagagcgagaaagagagagagaacccaaatgataaaggaaatgagataaaatgttaaaagcagatgaatctgggtaaagattatacaagtgttcctcgtgctctttttatttttgcacattttgtaaatttgaatttttttttatttttatttttttgatggagtttcactctgttgcccaggctggagtgcagaggtacaatcttagctcactgcaacctccgcctctcaggttcaagtgatcctcctgccggcatcttttttttttttttttttttggcatttttggtagagacagggttttgccatgtcagccaggctggccttgaactactgagctcaggcaatccacccacctcggcctcccaaagtgctgggattacagacgtgaaccaccgcgcccagcctgaaattacttccaaataaagagttttttaagtataggacaggagcggtggctcacgcctgtagtcccagcactttgggaggccagggcagggggatcacaaggtcaagagatcgagaccatcctggccaacatggtgaaaccccgtctctactaaaaatgcaaaaattagctgggcatggtggcgcacgcctgtagtcccagctactcgggaggctgaggcaggagaattgcatgaacctgggaggcagaggttgaagtgaactgagattgtgccactgcactccagcctggcgatagggtgagactctgtcccaaaataaataaaaataaataaataaaaataaaataaaaaagtatggcaagacagagtaccaaggattggggagggagtggtgagaaatgaaagcagcagctagttcttgaagagacctgctcaccatggtcagaatctggacttcggggcagtaaaaggtatattcccaaaggagtgaaaggagccaggcatggtagctcatgcctgtaatcccagcattttggaaggccgaggtaggaagatctcttgaggccaggagttcaagaccagcctgggcaacatagagagaccccgtctctacaaaaaaaatacaaaaattagccaggtgtggtggcacgcacctgtagtcccagctactctggaagctgaggtgagaggatcgattgagcccaggaagtcaagtttcagtgagccatgatcacgccactgcactccagcctgggcaacagagcaagaccctgtctccaaaaagcaaacacaggacaaaaaacgaaaagggtgtaggggaaggggttgaccttggaggaagtaccaggatagagaaaagatgggcattttgcaggctgagtagaaggatgcatggtggtcatcttcttagctctggttatgtttgagcgacacatcatagtacagatacaaagatgaatgaggcacggtgggctcttctcaagaagtctggtggtgtcacatcctggagaactggttgcggcagtgtcctggagatgtcagaggcggccacagaagggcacgggcttcaatgtcaccttgcaggactggagaggggttggtgcaagctatatcttatagggggctgtctctccagctggcctagaggatgggggttaagaagagacttgagttttgtaagagaaaaagcctccctcagactctgaagacgatcaggatccgcccacccagaggaagaaatgcgtggctctgtcaacttttcaggtcataggtcttgagtgggagaatgggagccctttttcaaccccacccccaaatttcctcttgccagtttctttctccctcctggaaggaagcctggacaccacattctgggagatcataactctccccctgagagctatttgctggctctccccacagaaagaccttgggagggaagcacagtcacctgtcatggcaggagctggcaagctgagacctctcccttccactggccctgccttcttcagggccaggcttcctcatgggctgtcccttcagaacccagcccacaccttttcaggaagccactccccacaaatcccctctggtcctatggacatgcgcattacccttctctgggccttcccctgacttcctcattggtgtcaatttttttttttttttttgagacggagtgttgctcttgttgcccagcctggagtgcagtggcgcgatctcggctcactgcaacctccacttcccaggttcaagcaattctcctgcctcagcctcctgagtagctgggattacaggcatgtgccacaatgcccagctaattttgtatttttagtagagatggggtttcaccatgttggtcagactggtctcaaactcctgacctcaggtattccgcccgctttggcctcccaaagtgctgggattacaggcatgagccaccgcgcccagcctcaaaactttcttctcagttcacattccttcctttctgccaatgccagtagggtgaatcagataacctagagtggtgagctagctaatatggcagtgctgtccccagaaactactggaataagggggaacatcaggcacctacaacctggagagaaagacttgtcaggcaggtctgcttcctgctgccttgggcacttccttcgggactggtttgttgagagggttgagaatggattggaggggggggtggggatagtgggggaactagaggcaggaaagctcatcaggaggccttgctgcacttccacatagatgggggcctgacctgaagtagtgaccgtgcatggagagcgaggttgttgaagtgaaaacgtgaaggctagaacaggcctgacttgatgactaggcctatgggagtgtgagacgagggtgtgcccagatttcctgcttggccaggtaggtgagtggcagtgccacttattgagaaagggatcatcaggcaggacaaactgtgagtttgagggggaaggaaaggatgacaagttgtgttgggtagattcaatttgagttgcctataggatgtgtaagtggggctgtccaggaggcacttggatgggagtgtgtgtgtttcgagcacagaagcaaagtctagtctggaaacaagagtattaattttctctctctcactgtttctctctccttcacacacacacacacgtgtgcgcgcgcacacacacacacacgtgcaaacaccagaactttcaaagctaggtgcactcacagggtcattaagcccaggacatgttgacaagggtgtggaggtgtcatcctcggggacatgcagggagggttcctggacagtgatttttacatcgcctccttaattgtccataaccataaccatgatccatagccataaggacaataggaattgtggtcccccagagatttttttcctactgaaactccatagtcacacctctttgcagactttatggcaggccttcccttttttccaaacccctgtgaatagtgtcagacagcatctgcgggaggatgtgtgtgaatgctgggatgcagggggcatggcagggagtggagcacttgtaattctgttgatgttggagccctcccctttcagagtgcattgagtccttagtgtgtgccccctcgccccgatcaattcccaatccctgtgttgcagagagggcagcaccaccttctcagccgcacaggatattctcaggctgatgccaagagcaaatcactcccagccagcacacttctgccagccttggtaggcacagcgtgtagcagtgcgcatgtgggtggggacagaggtgacttttctcatagactgggagaaaaaaaaaggcatctgaacttcctggttacagaacatccggctagtagaaacctttgtgtgtttgtacgtgtcgggcagggggggattagtgaggttcccctcccctctagtgttagcaataatgaaggacactctttgtacaagacgtcaagatgagagcttccacacaggactccacactgtgcttctgtttcaccaggaagaaatcttgaatgtcagccaggcttgtactcatcaattcattcagccagtctctgagggctggtccttctactgagtgctggctagggtggggctgaggactgtgcccctggagagctgccagcctaggtgcaaacacagaaccttcattcatgcagtgacatcacagcagcccatcacaacactgccccaactgcatcagagcagttgcacctgataggtttcccaggggttacctgaggagcaaagccaagtgcgtgtggcccaaagtagacagcatatagggcctgcacgctgaggactgccccaaatgctggcccagctttttccaccagggagggtcagattccaaagccgacagccactcagcacgaggcccagacccaaattccactgccagccacttctactgctgaaaaggaaatagggccgaaaatgtagacttcaagggcaaacactggatcacccttgggagtagcttccagagctctgagtaacatcctggaggcagaagagaaatgtttgccctgccccccagcccacagtctccagcatcaccagcctttctggaaagccttccgaagtcaatttcagcccagccaggagcagggccaagttgacagagggctgagccagagctcccctgcactcacaccttgatctttctcttcctcttagacttgagtgcttgccaggtgtgcattccagagtcaatgcaagtgtccctggctctcttccaccccttcccaggcaaaaagaggccacccacccatggaaaagccactgttgtcaatctgtcgccagaactctcgctcaaggtggcagtgaggctttggtgccagctagggtttgctttggaatccaggagctcccatcaaaggcggtgggctatggggtcctgaatgaatggcaaaggggcatgggagtagggatgagggtcattcaggacttggaaatatagttggccccgggtatgtgctggagctggctccctctggcccatgagagccagatgctatattttcagaagttttgtgagtcagtcattaagcatagcacttattttaaaatatataaaattacaattaaataaattatattaaaaactaaggtaatcaatgtcccaaaactcatcatctcctaatcattttactttttttttttttttttgagatggagtttcgctcttgttgccaggctgaagtgcaatggcacgatctcagctcaccgcaacctctgcctcccgggttcaagcgattctcctgccttagctttccaagtagctgggattacaggcatgtgccaccacgcccggctaattttttgtagttttagtaga[133 bp omitted]tgctcttcagatgatttatgtctacagtatctgtagagttgaaatactgtataatagtgtgcaattgtgtctcttcccaacatcacattgaagttaactgcttgaaatcagccacagtgggaacacttacaactcagaaatcagcaaatgctataaatcaggcttgatctattcttttgttgtctatctagaggaaagaaagcaatagaaacaatgttaataatgcagataaaactcaaaggtgtgccatatctatagctgttagattgtgaataataccaaaaaatgagaaaatagtcttccagagtttgaaaaccactaacctattcagcaaggaaatcagccaggcacggtgtctcacacctgtaatcccagcactttgggaggctgaggctggcagatcacttgaggccaggagttcaagaccagtctggccaacatggccaaaccctgtctctactaaaaatacaaaaattagccaggcgtggtgctgtgcgcctgtaatcccagctactcaggacgctgaggcacgagaatcacctgaacccgggaggcagaggttgcagtgagccaagatcacactcctgcactccagcctgggcaaacagagtgagactccatttaaaaaaaaaaaaaaaaaaagaaatcactcacattgtggacaaatgaatgcagttctgacatcattgtttctcacttaaatgaaaatatcaaccaacatgcacgtcagaactacatttgttcggccgggcgtggcggctcatgcttgtaatcccagcattttgggaggccgaggcgggtggattatttgaggtcaggagttcgagactgggctggccaacatggtgaaactttgtctctactaaacatacaaaaaattagctgggcatggtggtgcacccctgtaatcccagctactcgggaggctgaggcacgagaattgcttgaacctgggaggcagaggttgcagtgagctgagatcatgctactgcactccagcctgggcgacagagtgagactctgtctcaaaataatagtaaagttctaggtaacagtagattaaatgtttatttaatccattcatccaactaatatttattgagcatctactatgtttactgagtgttgattaggtgccgacctgtaatatcagctactcgggaggctgaggcaggagaattacttgaacccaggaggcggaggttgcagtgagccgagatcgtgccactgcactccagcctgggcaacaagagcaaaactctgtctcaaaaaaaaaaaaaaaaaaaagaactacatttgttcatcaagtgcaaccacagatataagagttgggcaacaatcgatgaaagcattctgtgagaatcacttggctatattgaatttacaataaataatattgtatattttattgttatggctaattcgtgtactatatatcctttacataagtaaaatttataattaattagcttatgtacataaacacacaaaaacatacacataccttaccccaccccgagagctggtcgttaaacatttacaaactcaccactggttaagcccaaggttcacaactactttggcaccagaaacacaaggttcaaaggtcccagaggtactccaaccctgaccagaacatgatggaggacagacaacgtggctagaaaacatctatgtgttaaaaaagcaaagcaaacaaaaactttttttttgctctcactaggccataaactccatgaaggtaggaacttcatctctgccattcatagtggtatctttggcacctagtcagctcaatcatttttttttttttttggtgtgttttgctttgttttgtttgagatggagtctccctctgttgcccaggctggagtacagtggcctcatctcagctcaccacaacctctgcctcccggggttgaagcgattctcctgcctcagcctcccgagtagctggggttacaggcatgcgccaccatgcccagctaatttttgtattttttagtagagacgggtttcact[133 bp omitted]tgaaacagagtctcactctgttgcccaggctggagtgcagtgacgcgatcctggctcactgcaacctccgcctcccaggttcaatccattctcctgcctcagcctcctgagtaactgggattacaggcgtgcaccaccacgccaagctaatttttttttgtatttttggtagagacggggtttcg[142 bp omitted]acccaggctggagtgcagtggtgcgatctcagctcactgcaacctctgcctcccaggctccaacgatcctcccgcctcagcctcctgagtagctgggactacaggtgctcaccaccacacctggctaatttttgtatttttggtagagacggggtttcaccatgttggccaggctagtctcaaactcctgacctcaagtgatccacccacctcagcctcctgaagtactgggattacaggcgtgagccaccgcactcggcctcaatcagtttttctagaaaaaaatgaatggctcttctatgtcagctaactttggtttgacttctaacatcacccggggatggccttgagtggagagccaggcctgcattcctcagtctagaaatggccctctccacgggttccttgcttccctctcagtccagctcggcaaggactctagttccagcatgcttccttgatgcctgccaggaagagcaactgctttacttcctgaacactggcattgaattaaaacctagctggttccccagaaggtggcccaggctagctagatgcctctgccccttgttcctggatctgacaaaccaaaccactttggtctagctgccaactgtggctgtgtggacagaattaaaagaggtcatgggaggatgtaaggagagttaaagcaatgagggaagtctagaaaaataaatccaaaatgggaagtcatttgctttgggaaaaaaagcatagacctgtctccctgactagaaacctaggaggctttccagttctatcaaccacttagtagctgtagacctcggacaagtcgctttaactttctgatcctcaatctgcttacgtagaaaaagacataaaaaaggctattccagaaaatctcagttccctcaccctccagttttgctggtcttgagggcaactgctaacagactcctggaaggaatcctttttttttttttttttttttttctgagtcagagtctcactatgttccccaggccagagtgcagtggcacaatctcagctcactgcaacctccacctcccaggttcaagcgattctcatgcctcagcctccagagtagctgcgactacaggcgtgtgccatcacgcccggctaattcttgtatttttagtagagacggagtttcaccttgttggccaggctggtctccaactcctgggctcacgtgatccgcctgcctcagccttccaaagtgttgggatttacaggcgtgagccaccacacccggccgggaattcttacataccagaagaagggcattatttcttctggtatatatactttctttgggaaaggtgtgttttgtggcaagtggggaaggggttgtttgttgattggtttattttttagagatgggatctcactatgtcacccaggttgacctcgaacttctgggctcaaataatcctccgccctcagcctcctgagtatctaggactataggcatgcaccaccacacctagcttggacaggtgtgtttttattttctttttttttcaccttttttattgttttaattttttttatttcaatggcttttggcgtacaagtggtttttggttacatggatggattatatagtggtgaattctgagattttagtgcacccatcacccaagtagtatacattgtatccattttacagttttttatccttcacccactcccaccctcccctttctgagtctctagtgtccatcataccactccacatgcctttgtgtactgatagcttagctctcacttctgagtgagaacatacagtatttggttttccattcctgagttacttcacttagaataacagcctccagctccatccaagttgccgaaaaagacattatttcattctttttctttttctttttttttctttttttgtttggagatggagttttgctcttgtcacccaggttggagtgcaatggctcgatctcagctcactgcaacctccgcctcccgggttcaagtgattctcctgtgtcagcctcccaagtagctgggattacaggtgcttgccaccacgcctggctaatttttgtatcattagtagagatggggtttcaccacgttggccaggctggtcttgtattcctgacctcaggtgatccgcacacctcagcctcaggagaatcgcttgaacccgggaggcagaggttgcagtgagccgagatcatgccactgcactccagcctggagggcaagagcaaaactctgtctcaataataataataataataatggccattctggctggggtaaggtggtatctcattatggttttaatttgtatttccctgatgattagtgatgttgagcattttttatgtgtgtgttggccgtttgtatatcttcttttgagaaatgtctcttcgtgtcatttgccccctttttaatgggattatttgtttatttgttttcttgctgatttgtttgagttccttgtagattctgtatattactcctttgttggacgcatagtttgcaaatattttcttccattctgtgggttctgtttactctgatgattttttcttttgctgtgcaagaagcttttcagtttaattaggtcccatttatttttgtttttgtggcatttgcttttcgggtcttagtcataaattctttgcctgcctaggcaaagaatgtccagaagagtttttcctaggttttcttctagaatttttatgatttcaggtcttagatttaagtctttgatccatctcaagttgatttttgcataaggtgagagatagggatacagtttcattcttctacatggggctagccagtttgcccagcaccatttattgaatagggtatcctttccccaacttacgttttcgtatgctttgtcaaatatcagttgtttgtaagtatttggctttatttctgggttctctattctgttccattggtctaatataactacttttattttattttatttttattatttgagacagtctctccctgttgcccaggctggagtgcagtggcgtgatcttgacctaccgcaatctctgcctcccaggctcaagtgattctcctgcctcagcctcctgagtagctaggattacaggcacgcaccaccatgcctggctaattttcgtactttcagtagagatgaggtttcaccatgttggccagcctagtctcgaactcctgacctcaggtgatccacaagcctcggcctcccaaagtgctgggattacaaatgtgagccaccgcgcccagttaatgtaactacttttatatcagtactattttgttttggtaactatagccttgtagtataatttgaagtccggtaatgtgatacctccagatttgttctttttgcttaggattgctttggctattctggctcttttttagttccatatgaattttaggattttttctgattctgtgaaaaatgatgttggtattttgataggaattgcactgaatctgtagattgctttgggcagtatggtcattttcacgatattgattctacccatccatgagcatagaatgtgtttccatttgtttgtgtcatctatgatttctttcagcagtgttttgtagttctccttgtagagctcttccagagaggtatgtttttaataaaataacttatctttaaatggaagcgaaaacgtgtggaaaacatcccaattggtgaggcagggtgaaaagaaatactgcaatttctgaaagctttggataaactcacacctgatagtttaccaaaggactcaaagatgacatttgggtcttcatgttccatgatgaccttgtctgagtcagaggaatccatggctcagccacagggtggcattttatgttcttgtgttctcacatccttcaaacatcctcactgctgcatatgcacgcccacaccttcttcccacatcccgaaaccactgcccgaagacaggccaggtgatcggcaaaatgaagcccctcagcttccagtgagcagacagaaggcttcttctcagcccctccttccccttgctgcttcccaggggagaggcagactgtggccctatgattttaggagcagtccctgtccccagttgcaatatgggttcaactcccgactatttattagtcttaggcctcttgctctgccctattttatgatgttcagaacaactctatgaaaatgataaggctggcatttttcaatcctgcctcta[132 bp omitted]agctatgattgtgccattgcactcagcctgggcaacagtgagaccctgcctgagaaagaaaaaaaaaaagtagtgtttttttcttactacttctcttttcagaatgctttcaactgcctgctattttgagtccaaattcgtggcatgaccttcaaaaacaagttatcattaattcagcacttactatgtgccaggcgttgaatctcttgtatcccctgaacctagtaacaactgtaggacaggcatgccactatctttcaaatgagtgaataaatcctcagaacagccagaaaagcaggtattattattccccattctattaatgaggagactgaggcctagagaagttaagccacttgcctgaggtcacagttaataagaagaaaaatcaagattcaaacccaggtctgtctgattctaaatcttggggatgctatatatatatataaaaatatatatatttctatatatagaaatatatatatagaaatatatagaaatatatatatcttattattttattttattttgagatggagtcttgctctgtcacccaggctggagtgcagtggcatgacctctgctcactgcaacctctgcctcccgggttcaagtgattttcgtgcctcagcctccccagtagctggaactacaggcgtgcatcaccacacacagctaatttttgtcttttttggtagacacggggttccaccatgttgcctaggctggtctcaaactcctggcctcaagtgatccacccacttcggcctcccaaagtgtggggattacaggcgtgagccacagtgcccggcaatatatggctttttaagtctcctccaccctcagcctccagagagcagacagacaggaacgttctggcctagcagacagccgtgtgatatttttggttccagttattaccgtggagatggttgcagctttctaggcagatggaagcacgccagctgccccatctacagacaccgccctccacaaatagcttatcaaaccctgaggattgcaatataataaagcagctgcccctgggaactcccacagccctcccaggatacacaccgttggccagccccaaccgctggtccacccctggaagaaggacttcttggaaaacctgttgttagaaggatttccttctaggtagctgctgtgcagccagtaaccagggctgctctcagggaggatggctccacctttcattgtgcgggcctccctgtagccagctctgctcctgtggaacctactgacctcttgtgggcagagtgtaaatgcactgcagctggacagcctcagagggtgcgggcttcagccagctcctcagtttgatttgtctctgacaatgctggagtgtgctggtctcttgacctcgctgcgccttggtttcctcacctataca[133 bp omitted]ctcccagattcaagcaattctcctgcctcagcctcctgagtagctgggattacaggcacgtgccaccacgcctggctaatttttgtatttttagtagagatggggtttcaccatgttggtctggctggtttcaaactcctgacttcgtgatccgcccgcctcggcctgccaaagtgctgggattacaggtgtgagccaccgcgcccggccgagaaaaggctttaattggggggaaatatatgggtaaattcaagatgccaaggtcccaggtgggcactcacaaaattgcagtacctgaccagaatgattagatattatccaacagtgctcattaacctttttaagtctgcagcagacacagaaaatggtatttgtgttgcacaaagaaggaggcttcttgtggccagagctgccccaggctcagcccagctaccccaaaggctgagagcagcaacatctcaggattcctggaatctttttgcagcacgtggggttgacagatgtgactgtattatacaagcagttgcagaagcagtgagcattgtcaggattctctttctcctctttccatataagtcagttaacaaaacgtttgggtgggtggccctacctcttagacacccacagagtccatagacacaggtagaaaccatcattgcacagttgggcaagggtcttatatgcctggcccaggcacaaggcagggttccacaggctctggatcctttgtgcttcttttgtaatgcagagaaattaagagatcacagcagattgtgttttgggataatctgggtctgtcagataccaaagagcctcctgtctcccgtcaaacctcgtttccttttctcctgctgtctacttgcactccactgactcattcatccaacaagcacttaataagtggcaaccaagcaccaaaccttgtgccaggtcgtgggattacaggatgaaactgttgccttcaaggaactcagtctcatagaaagacagacacagaaagagaggcactggataggctgcaagagatccagtggatgtctgtaaagaggagaggaagtgcgagggcctaagtcaacctcagagagtcagggacacttgtaaagacacctgaagattaaataaggggtgggggagggaagagtaaccagggaggaacaaggcagctttgcagagagaagaacatatgcaaaggaggccccaagacatgacaaaatgaagcatgttcaaagcacttcaagtagcccagttgtgctagaatataaagtgctagatggggcgggggcgatggaaccagacaggcaagggccacatgagaggggtgccaattgaaggggtttttattcaatacttcatcatttattaaatagttcagccacaggcacggtggcttacgcctgtaatcccagcactttgggaggctgaggtgagtggatcgtctgaggccaggagtttgagagcagcctggtcaacatggcgaaacgcctctctacaaatatacaaaaattagccgggcgtggtggtaggctcctgtcgtcccagctactctggtggctgaggcatgtgaatcgcctgaacccaggacacagaggttgcagtgagccaagatcgcaccactgcactccagcctgggcaacaaagtgagactccgtctcaaaaataaatagataaataaataaataaaggcaacagggggccactggggcatcttaaacagaagaatgccatgatccaaattacatttttttttgagatggagtcttgctatgttgctcaggtcagccttggcatcctgggctcaagatatcctcctgcctcagcctcctgagtagctggaactacaggcacgtgccaccaaattactttggttgttgggaagtaagtaagaagggagagagattgtgctgagagaaatctgttttctggcttgagtaaccagatacacagtagcattcactgaatccgggaacacagggaggacccagtttgaagcagggaatgaagacaagagccattgtgaatacactgggtttgagatacctgtaagacacgaacgtagggtgtctaatagtcggatataaaagtgtttcatgggtagggcacagtggctcacacctgtaatcccagtgcattgggaggcagagcggggaggattgcctgaagccggaaatttggggctgtagcaggcaatgatcacaccattacactccagcctctgtgctccaagctgggtgacagagcaagaccctgtctcaaataaataaataaagtaagtaaaataaaaaaataaagtgggtgagggccagatgcagtggctcacgcctgtaatcccagcacttggggaggcccaggcgggtggatcacttgaggtcaggagttcgagaccagcctggccaacatggcgaaaccccgtctctaccaaaaaatacaaaaattagccaggcgtggtgatggacacctgtagtcacagctactcaggagggtgaggcaggagaagcacttgaacccaggaggcggaggctgcaatgagccgagattgcaccactgcactccagcgtggacaatagagtgaggaaacaagaaaaaaagaaagaaagaaagaaagaaagagggggagagagagggagggagggaggaagggagggaggaaggaaggaaggaaggaaaagaaagaaaagaaagtgggagagggccaagtgtcctagaaatgaagggaagaggggatggccatcggagccacactcacatagaagtcaaataagacagggctgaaaaaggagaaccatttcagcagtgatggagaccgaagcaagatcacagtaggcctcttcaagaagcttagactgtgaaggggaggaaagaatgaaagctagaagtaggctctgtgtcaaaggtttttgttgaaggcattagttcaaatgtacatgctgaggaggagagatggagaaagaggggaaggttgaggcttcaggaaagagaggaggtaagtaatagagcaaagtccaaggggaagtgaggaggactgaactgaatacatgggggaggtgggtgtcagcctggggcaggaggagggagttaggggagggggagagggtggtgcaggttggatttgctgagcagactctgagatggagattagcatgcaggaggtttcttagggagtactcttgggatcatcacgcgtggaaaggaaggaatggaagcaggactggagaaaggagacattgggctgcaatgcagattcaacaaaggcctcagccagacctatgggaagctctgaagctaagagtggagacaagggggccaggcctttatatccccacatcagtcattcattggacacaggctgtcctgggaaggaggcatgcccttgggcaaagtgggtttcttcagctgaggctgtccccaaaggggtccaccagctgagggctctctactgttaggcactgagtctttctgttgtgaagatcagggaagcacattgcagtgtctcctatagagaggaagggggcgctattgcatttgagttgaatctgcagcccagttggtgtgaggctgaagttcacgctgttggcttcaattttgctccgtgaagatggaaaccaatctttctgatgaaaagggggctagctggggttgggggctagaggagagtgaaatgatgatgaaatggctgcttcaggacactgaagatgcgctgaccagggacatacaataggattgccaagcgatgttagggtcttagttgaaactaaaaaaatcattttagcaggcccaaacagtgtcgcgatttcaaggctctgtcattcttggtcacttggatatctgtccttcctcctatggatttttgttagtttttatgaggaaatgtctatattatttagaggagaatattttgtgagaccgtgttcctaaattctgcaactttttacctaaactacttcctgaaccaggcctaaattcaaggccttcagtatataattacaattttcgctacaacaatcgttgctgatgctaatgatgacaatcttgctagtggcaaacaaaactgtgtggatattaaaatattataaaccaattagaaaatgacttcaggcctgacaataaagaagataaacacttgtctacaagtagacaaataaaaatcaggattaaatctaattagcaggcaaatacaaaatgtagaaaattacaaaggaaaacgaaatttgaagcttcaaggaaaaaaaacactgctataataacgaaatatagaacaggtggttcatcaggtactagagtgacaatagacaagtacaccgtccaattaaacaatcggcttttaaaatccatacaggaattatgtggatgatcattcaaaaacaatgtctcactgttctgtgaagaaagggtcccccacatgagggggagcagttataatgagaattcactaggcctaaagtgtaggctaggtaaccaaccgtgccttgctcacgaaaccagcttgttattccagagtaactatgagcaagcaacaaccatgttcatagtagcagtagcaatacggttctttcgttttgtttttttttgagacggagtttcacctcttgccgcccaggctggagtgcaatggtgcgatcttggctcactgcaacctccgcctcctgggttcaagtgattcttgtgcctcagcctcctgagaagccaggattacaggcgcctgccaccacgcccagctactttttgtatttttagtagagacagggtttaccgtgttggctgggcttgtctcgaactcctgacctcaggtgatccgcctgcctcagcctcccaaagtgctgggattacaggaatgagccaccacgcccggccagcaatacagttcttaggggaaaaaatgaaatgtccagttcaagaataaaatcaacattcatgatggggcctcactcggcctccctgcacagatttgtcaccgaacatacatttcaacaaaggctttggtgcccaagtgacttcaattgtagaaattttaggacataaaggatggaagacctatagggaaactctttaggaggaattaaccaggtgtaccttaaaatcactctagggccgggtgcagtggctcacgcctataattccagcactttgggaggccgacatgggtggatcacttgaggccaggagttcgagaccagcctggccaacatggcgaaactccatctctactaaaaatacaaaaattagccaggcgtggtggtgcacccctgtaatcccagctactcgggaggctgaggtgggagtatcgcttgaacccaggaggcagaggttgcagtgagtcaaaatcatgctactaattaggagatatacctaatgtaaatgacgagttaatgggtgcagcacaccaacatggcacatgtatacatatgtaacaaacctgcatgctgtgcacatgtaccctagaacttaaagtataataataaaaaaaaaatcatgctactgcactccagcctggactacagagtgagactctgtctcaaaaaaaaataaaaatcactctagatatgaggggagtcggtactctttccagcccaactttagagaacagctggagatacccacagcctccaacggtggaacacttccagcaagtataatcttacagctcttttctaccagcctgcctgaccacgaggcactaatcccaggagctccaactactgttccccagtcctttaccccctatctcagaaagacacacatgtactgtcaacttaaataacagaaagagactctctaatagaaaatgacatttattcgggaatagggcattgcaatgggaataataacaccatagtaaactatgtgcatattcagggaggtaaaggaagacaaaggcttttaaaggaaaaatgggccaggcgtgatggctcacgcctgtaatcccaacactttgggaggccgaggcgggcagatcacctgaggtcaggagttctagaccagcctgaccaacatggagaaatcccgtctctactaaaaatacaaaattagctgggcatggtggcgcatgcctgtaatcccagctacttgggaggctgaggcaggagaatcgcttgaacctgggaggtggaggttgcggtgagccaagatcacgccattgcactccagcctgggcaacaagagcgaaactccatctcaaaaaaaaaaaaggaaaaatgaggattatataattgtttttgaaatgattatccttggctacaaagatcaataacaagggtgatgccagtctgaggctggacaggcagttgctgggcagatgtccttgcagaagtttttttttgttattttgtgtgtgtgtgtctgtgtgtgtgtgtgtgttttttttttttttttttttttttgagatggagttttgctcttgttgcccaggctggagtgcaatggcatgatctcggcttgctgcaacctccgcctcccggttcaagtgattctcctgcctcagcctcccaagtagctgggattacagctgcccgccaccacgcctggctaattttgtatttttagtagagatggggtttctccatgttggtcaggctggtcttgaactcccgacctcaggtgatccacctgcctagctctcctaaaatgctgggattacacgcgtgagccactgcgcccggccagaagtattttttgtgtaaggttgcaatggccattgtgcaaggttgtggtttttgtggagttttttgtgatagtcttgttatcatacaagtgtgagaatcctctcttacatagccttgcctagctctatgtgtcagggctttttaaaaaatataaaagtgactccattttgattctgacaactttcacagtacacatgcacagaaaaagtattgatgatcttggtgatcttctgaatctccaaggatacctaccttaccatgttccagacaatctactaagggctttgtgctcatattacccctttcttcctctcaagaactctataaagcaggtacttctattatccccattttatagatgaggacatggatgcacaaagaggtaacatgacttacttaagatctcagccagtaagtgacagagccaggacacaaacctaggcgatctgatagtaaggctgtacatttcccctaatgctatgatgcctcccacattttgaggactagaccagtgattcctaaccattcttttttcattggtccctctgaaaattgggtgaaatcaacaaatcctctccccagaaaaatgcccatctgttcacaagcacacagaacatatttaatttcaaggagcttggggactccctgaagctcatccctgaagcccatggagcccaggttaagagcttctattgtgtaggctagcacgctctcgggaagcaatttggcctagaccccacccaactcatcataccccttgcttcccctgggagagctcaccccctgtgctttaggctactctcacagctgaagttcagaatgctctagggctttgtaacctggctttgtaacctgacacttgtgacctcatatttgtcccaacatactatgtccatgccatctcctgctgcaccaggatgaggtctctactgggctagcccagccctggtccagagaagataagctcaaagattgttcacaaagagagcagggcatagtgcttcaactccagaaacagggagggaaatcaagttccctggcagagcaaataaaaactggtgatgcccaaaagccaagacttggaagcaacctaagtgtccatcaacaggcaaatggataaagaaaatgtggtacatacacacaatggagcactattcagccataaaagagtgagatcctgtcatttcaataacatgatagaactggagggcattatgttaagtgatataagccaggcacagaaagacaaactttacatgttctcacttatttgtgggagctagaaatgaattcatggagagagagagagtagcaggatagttaccagaggctgggaatggtagtggggagttgtggggggggaagtgtggatggttaatgggtacaaaaaatagaataagatctagtatttgatagcacaacagtgtgactatagccaatcatttaattgtacattttaaaataactaaaagagtgtcattagattgtttgtaatacaaggataaacgcttgaggtgacggataccccatttaccctgatgtgatttttacacattgtatacctatatcaaaatatcccatatgccccataaatatatacacctactatgcacccacaaaaataaaaagaaaactggtgatgccaagggctccccaaacaatggccagaactggaagtacagtcaggaaaggatacaagtggacacaggtggaaacctgctctgggggcatctagggtgggtgctgtggtttggcctccccaaccagacattcagatttgagctgctccagagcgctcagcaggaaagacatgtgagattcacatttgaactcagaataggtcggggaaaaccacatttgcggttcattcattctgtcaacagatggtatttagcatttgttttttgttgttggtttttttttgttttgttttgttttttgagacggagtctcactctgttgcccaggctggagtgcaggggcatgatctcggctcaccacagcctccacctcccagattcaagcgattctcctgcctcagcctcctgagtagctgggactacagatgtgcgccaccatgcctggctaatttttgtatttttagtagagatggggtttcactatgttggccgtgctggtctcgaactcctgaccttgtgatccacccacctcggcctcccaaagtgctgggattacagccgtaagccactgcgcctggcctgtttttcgttgttattgttgtttttgagaccaagtctcattctgttgcccaggctggagtgcagaggtatgatcttgtctcactacaacctctgcctcccgggttcaagcgattctcgtgcctc[134 bp omitted]tggcctcccaaagtgctgggatttataggcgtaagccaccgcgcccggacggtatttagcatttgtttccttaccaagcagttatctgccaggcactgtactaagttagcactttacaaatatcaactcacttaattttcacaaaaccataatgagatgagtactactattgtccccattttagacacaggaaacctgaagcacaagagagattaagcgacttggccagttacacagctagtaagtgacagagccaggacgcaaatctaggcgatctgatagtaaggatgtacatttcccataatgctatgatgcctcccacattttcaggaccagatctgtgattcctaaccattcttttttcatcagcagagctgggactcaaactcaggcagtcaggcctgcagcacccatgctctgaaccaccgtcttctgcagctagtgtgatccagaggcttggctagttactggcaatagagcagtgaacaggccagacatgatctctgccttcaaggtgtttacattctagagtggcccctgagtagtcaacaggcaattccatcaagttatgatgagttccatgttgggggtccgggaggctgtgagtgggctccatattgggctgggttctgggcttcagagcagaagccaacaggttgtagggacacctttcttgggttcaggatcaaagaggccaaacaggagtaggggagccatttctgattgtggggcctgcctttcagctcccattctgaagctgggaaaccaaacagctgtgagtgagtctcacatcaggaacagaagcagcacaggaaccaaacaagcgtggtcactcccgccaggggtatcagaacagcagatcctacagacctgtttcctcatcaatctctcctcgcagagactacaagctccctgagggtaagacctaggcctgcctttctccctcattctctcagtgcccagcacaaggttggcacctaatcaacactcagtaaacacagtagatgctcaataaatattacttggatgaatggattaaataaacatttaatctactgttacccagaactttactcttattattattttttatttatttattttttaagacagaatctcgttctgtcgcccaggctggagtgcagtagcatgatctcggctcactgcaacctctgcctcccaggttcaagtgattatcgtgcctcagcctcctgggtagctgggactacaagcatgtgccaccacacctggctaattttttgtatgtttagtaga[141 bp omitted]gcagtgaacaacaacagaaaaaatccctgtccccactaaacttttagcttatagtgggagcaccagacaatgagcaaaatgagcaaatatttatatagggttttagcgaaaaactataggaggagagggggataggaagtatgaggaggcgatgaaattttagatacaatggtcagcaaaatcctctgagaaaatgacattttctcagacaaaatcaagacctgaaggaagtgagggtgggccgtttgcagatacctgaggaaaaaatgtcaaggcaggaatgtgcctggcatgtctgagggccagggaggagatcactgtggctggagcagagtgagctgatagggactggagtaggagttgaggtcagaatgaatgaacaagtggagactgggaatggtaccaagaagcaggggaaccaaaccagttccacagccagaagccctccaagtcctgactggccccatggggaaagggagaggagagcccccacaagagtgcctattaactcacactcctccagctccattccaaaggcatgacttgagtccctaccccatgcccagccctgaaactcctggaaaaaaagcaggatattccttgaacctcctctttctcctcaattgggaataagggctgagctggcaggaacaagctgagattgagaattgacctgtagagcttacacagtccacccttcctccagaatattccatttgtccttggagacagcatgacggagccatgatgggctctggccatctgttccctctggtccttctgaaagaaaacactttcagaccaggcaccgtggctcatgcctgtaatcccagcactgtgggaggctgaggagggaggatcatttgaggcctggagtttaagaccagcatgggcaacatggagaaaccctgtccctacaaaaaaaaaagaaaaaaaaatatatatatatatatactctctctatatagtatatatataaggttggtgcaaaagtaattgcagtttttgtaacgtgatggcaaaagccacaattacttttgcaccaacttaatataaatatagttatatatataatgcttatacttaaatatataaaagccagacgtggtggcacatgcctgttgtcccagctacttcggaggctgaggttggaaggaacacgagcccaggaggtggaggctgccgtaagccagcatcacaccactgtaccctagtgtgggcaacagagtgagaccttgtctcaaaaacaaaaacaaaaacaaaaaacacttccaattagagtctttagacagcacatttctttgaaagttccacttttccaccctcctccctcactctggccccaccaccagaggcaaaaagagtcactggcactgccctccttttgggatccctgtgtccaaggaggtgggcctgcactgtccccaaagagttccaaggtcaaaccctccattatctaaaaaatggtttgggccgagcacggtggctcatgcctgtaatcccagcactttcggaggccgaggtgggcagatcgcctgaggtcaggaattcaagaccagcctggccaacatggtgaaattccatctctactaaaaatacatcattagccaggcgtggtggtgggcatctgtagtcccagctacttgggaggctgaggcaggagaatcgcttgaatctgggcagcagaggctgcagtgagctgagatcgcgccactgcgctccagcctgggcgacagagcgagactccatctcaattaaaaaaaaaaaaaaaagaatggttagaaggaactctttagacactttggacacaagcccttcacgatttttgtcttacaagtatgttcaccttctctgtagcttttctaccctcgatagcatcttttgatgagcaggtgcttttttttttttttttttttttgagagggagtctcgctctgttgcccaggctggagtgcagtggcaccatctcggctcactgcaatctccgcctcctgggttcaagcgattctctgcctcagcctcccgagtagctgggactacaggcgcccgccaccatgcccggctaatttttgtttttgttgttgtttttgttttttttttcttttagtacagatggtgtttcaccatcttggccaggctggtcttgaactcctgacctcacgatccacccgcctcaggctcccaaagtgctgggattacagacatgagccaccgtgcctagcctgagcaggtgctcttacactgaatgcggtatccatcttttctttcatggttagtggttttgtcttaagaggtctttcatttcccagagataatgaaaatgtttttattattttctagaagttttaccactttgctttttacatttagatctcatttacctggaattgacttttgtggatgatgagaggtagggggtcaagttttctttttgccatgggaatagacaattgtcttagcaaaatttattacaaaaaaattctttccggccgggcgtggtggctcacacctgtaatcccagcactttgaaggctgaagcgggtggatcacctgaggtcagaagttcgagaccagcctaaccaacatggtgaaaccctgtctctactaaaaatacaaaaattagccaggtgtggtagtgcgcgcctgtaatcccagctactcaggagactgaggcacgagaatcgcttgaacctgggaggcaaaggttgcagtgagccgagaccgcgccattgcactccagcctgagtgacaagagcaaaactccatctcgaaaaaaaagaaaaaagaaaagaaaaaaattatttcctcactgaatagcaggggcgcctttgctgtacatctagtgactgcacatgtgagcctgtttctggactctctattgtttcattgatctattgtccatcactgggccaataccatactgtttaaattactttcaatatataataaaacaatatctagtagaacaagtcctatcaccttgttcttcaagagtgatattggaccttttcattctgtataaatttcactcctattcttggactttctccttgctttataaatttaaattagcttgtcaagtctcccctgccccctgcccagcaccacgtggacatatgcacacgtggacacacacacacaattgttgagatttttattgtggtctcactgaatctataaatcagtttgtggagaactgacactttaaagctattgagtcttccacatgaacacagtgtatcattccatttactcaggttttaatttttctcaacgatattttatagtcttctatgtaaaggcctgcataatacttccttagatttatcctcaggtatctttatgctattttaatcatttaatatgtctaattttaaatgttacgtttccaactgctggttacttagatacagaatacaattggttttctatattaaccgcatgtccagcaacttctttttttttgagacggagtcttgctctgtcacccaggctggagtgcagtggtgcaatctcggctcactgcaacctccgcctcctgggttcaagcgattctcctgcctcagccttccgagtagctgggactacagatgcacactaccacacccagcaaatttctgtatttttagtagagatgaggtttagtagtggccaggcggtctcgaactcctgacctcgtgatccacccacctcggcttcccaactgctgggattacaggcgtgagccaccgcaactggccaacttttctaaattcatttatcaattcaaatatttattcttcagttattttggatattctatatacacaatcatgttttctacaaataatgatgttgttatttcttccaagtctttaaacgttttgtttccttttcttctcattgcactggctaggattcccagtaccatggtaataaagggaatctttgtctcatttccaacttcaggaggcaagcttttaagtatgcttgctgtaggattttttaatagatgccattaatcataatttaaaagttttcttctattcctagttcatttccatgtgtatccttacaattaatccctctcattttctaacattcaaaagagcctaattaaaacaatgataaatgtgtcactttcttttaaatattaatacctcatatatttttcttaaaaaaaaactttttaaaactagagacagggtctcaccatgttgcctaggctgctctcgaactcctgggctcaagcgatcctcctgccttggcctcccaaagtgctagaattacaggtatgaaccaccctgcctggctcccacatttttcttaatttttaattgacacataataactgtacatattatgggatacaatgtgatgttctgatacatgtatacaatgtgtaatgatcaaatcagggtaattaacatatccatcacctcaaatatttatcatttgtatgtgataacactcaaaatcctttcttgtattttgaaatatacattattgttaacaataatcatcctattgtgtaacagaacatcagaacttattcctcctaattgtaactttgtacctattgaccaatctctgccatccctccttccccctccccaggctatagtaaccactgttctatcctctacttctataaaatcaacttttttttacattcaatatgagtgagattatggggtatttccctttctgcgtctggctaatttcacttaacataatgtcctctaggttcatccatgttgttacaaatgatgggatttcatttctttttatggctgaataatattccatcgtgtatatgtatatatatgcgcgtgtgtatgtatgtgtatatatacacacatacacacatatatatatatgaactgggattgctgtatcatatggtagttctatttttaattttctgaggaacatcccatactgtgttccataatggctgtagcaatttacatttccaccagcagtatgtaagggttcccttttctccacatcctcgccaacccttaccttttgtctttttgataatagccattctaactaaagtgaggtgatatctccctcacatcacctcactttgatttgcattttcctgattagtgatgttcagcattttttcatatacttgttggccattctgtatgccttcttttcagaaatgtctataaaggtattttgcccgtttaaaaatcagattgaggccaggtgcggtggctcacgcctataatcccagcattttgggaggctgaggcggatggatcgtttgaggtcaggagttcaagaccatcctggccaacataccccgtctctaccaaaaatacaaaaattagccgggcattggtggtgcgcacctgtaatcccagctacttgggaggctgaggcctgagaatcacttgagcccggacggtgcaggttgtggtgagctgagatcgcaccactgcactccagtctgggtgacagagtgagaccctgtctcaaaaaaaaaaaaaaaaaaaaaatcagattaaggccgggcacggtggctcacacctgtaatcccagcactttagaaggccaaggcaggtggatcacctgagctcaggagttcaagaccagcctggccaacacggtgaaactccgtctctactaaaaatacaaaaattagctaggcatggtggcgggtgcctgtaatcccagctacttgggaggctgaggcaggagaatcgcttgaacctgggagggtgaggttgcagtgagccaagaccgtgccattgcactccagcctgggcaacaagtgcaaaactccatctcaaaaaaaaaaaaaatcggattgagtttttgctattgagtttgaattccttatacagtctggatattaaccccttgtcagatgtagaatttgcaaatattttctctcattatgtaggttatatcttcactctgtggactgtttcctttggtggacagctttttagtttgatgtaatcctacttgtctatttttgcttttgagttcatatgaaaaaaaaaaaaaaaaaaaccttgcccagcccaatgtcataaagcatttcccttttcttctagctgtttcagtttcagatcctacatttaagcctttaatccactgggttagtttttgtatatggtgagagagaggggtctggttttattcttctgcatatagatatgcagttttcccagcaacatttattgaagagactgtcctttccctaatgtgtgttattggcgcttttgttgaaaatctgttggctatagatgcgtggatttatttctgggctcactattctgtttcattgatcgatgcatcccagcaactcgggaggctgaaatatgagagtttcttcagcctgggaggcagaggttacagtgagctgagatcgcgccaatgcactccagcgtgggagacagagtaaaactgtctcaaaaaaaaaaaagcaccgattccatctggttgttttcaaaaggaaaaattaattgtatttctctgaaaatgaaaatgactgttttgggaaactctaagtttaccatccctggagactttaaagcaaaggctggaccagtatgtgtctaggaggctacacaggaaattcctgcacacaagagaaggttagagggtatgacatctaaggtcttttctaaacttcagtgatgaagatcctgtgactctgcatttctataaatcctatcattgggccaggcacagtggctcatgcctgtaatcccagcactttgggagtccaaggcagacaaatcacccgaggtcaggagtttgagaccagccaggccaacgtggtaaaactccatctctactaaaaatacaaaaattagccgggggtggtggcacgcacctgtaatcccagttacttgggagggtgaggcaggaaaatcacttgtactcaggaggcggaggttgcggtgagccgagatcgtgccaccgcactccagcctgggtgacagagtgagactccatctcaaaaaaataaataaataaatcctattattgtactgcttctgcaccagatcccattccctcctgcctactcaagtatattgcttcagttattttctctctcctgcattatcagtttttacttctctcttggatttttccttatcagcattcaaatatgctgttatttctcccatcttgaaaatactgttaatcttacttccccctccaaataccaccccctttctcttcttccctttcatagcaaaactccaaaaaaaagtacctatattcactacctccaattcctcttctttcattgtctcttgaactcagtcctgctagcctttcgcttatgccactccattcaaacaccttgtaaaagttaccaatgacctccccattgctaaatgcagtggtcatttccaagtcctcatcttgtctgtggcatttggcagatgatcatttcctcctcctttaaacacaggctggtcatttgtctatttgctctcagactcattccccgcttctcaaactcctgacctcaagtgatccacctgcctcagcctcccgaagttgctgggattacaggcgtgagccaccgtgcctggccccattccactcttcccctgctctgctatgtgcagcagacaacatttcccaggctcctttccctcctgacttcctgagaggtttggcctgtgaatgggaatctttggcagaagactggaaagcaagagaagggaagaagccagggtatttcctccctttctctctgttttgagcgtcatctccagcatagactgttatctcttctgtggctcccactagatagtcactccctccatggaccaagctcctgctgggctggtgttcctgcttctgctgggtggtccttgatcccggacttgggtaataccaccttctgcttttgtccctccagccctagaggtgaagtagcttcctgctgttgctaaatctctggatcaattcatcatcccttcctgggattctaaggtcttctatcccctgagtaccagttcctcatgttaaattctgtttacaactctgaatacgttttgttttctttttttcttttttaaaacggttgttcgctcttgttgcccaggctgaagtgcaatggtgtgatcttggctcaccacaacctccgcctctcgggttcaagcaattctcctgcctcatcctcccgagtagctgggatcacaagcatgcaccaccacgcccggctaattttgtattttcagtagagacggggtttctccacgttggtcaggctggtctcgaactcccgacctcaggtgatccacctgcctcagcctcccaaagttgttttctgttttcttaactggacctcgagtcatgtaaaacacttgcttctcttcactctcagttttactctgtcttcatccagccttagtagccattcctttgcagtcttttttgctgatttctcctcctctcttgaccattaaatgatgccccaggactcaatccttggacttattccctttgctatctgtatttagatctttggcaatttcatcctgtctcatggctttaagtaacatctatatactgacaactcccaaatttatatttctagctagaccttcccagttgagctgactacatatccaactgcctacctgacaactccacttagtcaacagacatttcaaacataacatgttcaaaatggtgcttggctttcccttgaaagctgttcttccccatctcagtaaatgacacttcaatttgcccagttattctagccacaattgaggagttatccttgattcccctcttcccctcacttctcacaccaaatctatcacccagtcctcataggaaaacctccaaaacacatctcaaatccattcactttctccaattcttcttttactaccctggtccaaccattctcacctctcacctggactaccgccatggtctcctaattggtctctctgcttccattctgcctcccaaaaagccactctccatgcagcagctagaatggctttttttttttttttttttttgagacagagccttgctctgttgcccaggctggagtgcagtggcacaatgtcggctcactgcagcctctgtctcccgggttcaagcgattctcacgcctcagctccagagtaggtgggactacatataggtgtgtgccaccacacccggctaatttttttatttttagtacaggtggggtttcaccatgttgcccaggctggtcttgaactcctgacctcaagtgatctgcctgcctcaacctcccaaagtgctgggattataagcgtgagccaccgcacccagcctcgaatgactttaaaacataaattggctgggcacggtggcatatgtctgtaatccagcactttgagaggccaaggcaggaggatcacttgagcccaggagttcaagaccagccagggcaacctagtgagaaaaaaaggacaggacaggacaggacaggacaggacaggacatgacaggaaaaagggaaggacaggaaaaagaaaaaggaaaggaaaggaggaatttctttctacaaaaaatagaaaaaattagccaggcgtggaagcacgtgcctgtagtcccagctactacttgggaggctgacgtaggaggattgcttgagcccaggaagttggggctacagtgagctatgatggtgccactgcactccagcctgggcaacagagaccctatctcaaaaaaaagaaaaaaaaaacctataaatcatatcatgttactcctctgcttaaaagccttcaatcaataacttctcactgtatttttaagaaccaaaatccttattcaggcctgcaaggccctacatggcctggtttctgctcactcctctgacctcgcctccttccacttgcttgctttctcttactcactacaacctagtcacactggccttatttctgttcctccaacatgtaaacttattccctttgtagggcctttgtcctttctaatgccatcatcacctggaacgctttcccctgatccttatatggctggctcattcagatccttcaggtcttatgtggctcagtgtcccctcctcagagcccatccttgattactcatcactcgctatcatatcacactattttcgtagataattttcttgttcacttgttcatctgtcacccctgccctcagaatgtgagctgctttgttctctactatgcccccagctcctagtgcaatatctggcatataatagatactcaatgtatactagttgaatgactaaaagtagattagccttaagtaggaagagggggatctcttcctctgagatttgaaagagaaaaagatggaggcagacacaactaagtgtgcccttaagttgctggtgctttggagatccctctctggtcatctaccaagagagagagcttgcagggagaggcttgaagaaagcagctgtaaactgttccttagggaaacaggagagttgctgacccaaaacatacattaggattgactagctgtggtaagaacccatctgacactggaaccataaattcacagtgccaaatatccactcattgacaagacatgaacactcaactatttgggtaagacatcagacaaaacatattgtaggactgattctaaattgagagtttgtaggacagatgttatagttttaaaagaaggtaagatctacaatagcaccggaaaaatgaagtacttaggtataaatttaaacaaaatatctgcaggacctatacacgaaaaaaataacaaaacactgatgaaagaaatcaaagatctaaacaaatggaaagtggaaagatacactttgctcatgggttggaagatgtaatattattaagatgtcaattctccccaacgtgatttttcgattttacacaatcccaatcaaaatcccagaaagaatactggagataccaacaagccaattctaaaatgtatactggaggccgggagcagtggctcacacctgtaatcccagcactttgggaggctgaggtgggtggatcacttgaggtcaattcgagaccagcctggccaatatggtgaaactccgtctctactaaaaatacaaaaattagccaggcgtggtagcatacacctgtagtcccagctactcaggaggctgaggcaggagaatctcttgaacctggc[139 bp omitted]gaacttgaatagacatttctctaaagatgatatacaaatggccaacaagcatatgaaaaaatgctcaacagcactaatcattagagaaatgaaaaaaaaaaaaagaacctacaatgagatatcacctcacatccattaggatgattactattaaaaaaataaaaataaaaaaataacaagtgttggtgaggatgtggagaaattagagccttggtgtattgttgataacattgtaaaatgtggccgggcgcagtgactcacgcctgtaatcccagcattctgggaggctgaggtgggcagatcacttgaggtcaggagtttcagaccagcctggccaacatggtgaaactccatctctactaaaaatacaaaaatgagctgggcatggtggcacacacctgtaatcccagctacttgggaggctgaggtgagagaatcacttgagcccaggaggcagaggttgcagtgagctgagatcgcaccactgcactccagcttgggtgacagagtgagactctgtctcaaaaacaaacaaaaaaagattgtaaaatggtacaagtgctgtggaaaacagtatgtatggaggtgcctcaaaaaattaaaaatagaactaccagcaatttcacttttgggtatatatcagaattgaaagcagggtctcagagatatttgcacactcatgttcattgtgctactattccacaatagcaaggggtggaagcaacccaaatgtccattgacggatgaatggataaacaaaatgtggtatagacatacaagggaacattactcagccttagaaaggaaggtgttcttcctttctaatgattcaacattgaggacattatgctaagtgaaataagccagtcacaaaaagttaaatgttgtatcattccacttacatgagatatctaaagtagtcaaattcataaaaacacaaagtagaatggtgttaccaggggttgtggggagagagaaagggggagttgttacttaataggtatagagtttcagatttacaacatgaaaaagttctggaaatctgtatcacaacaattcaaatata[135 bp omitted]acatggagaaacctcatctctactaaaaatacaaaaactagccgggcatagtggcaggcgcctgtaatcccagctacttgggaagctgaggcaggagaatcgcttgaacctgggaggcagaggttgcagtgagccgagattgcgccattgcactccggcctgggctatgacagcaaaactccgtctcaaaaaaaaaaaaaaaaagaaaaagaaaaaaaagaaaggttaagatggtaaactttatgtgttttttaccacagtttaaaaaaaaaaaaaaaggaaaacagtatgttccacaccatctgccattagggaaatgcaaattaaaattacaagataccatgaagaaactgttgcaaattagagaccaaggagacatgggcagagtgacatggaacctaaaatggctcaggcaacctagttttttaaaaatcttttcaatttatcttaaaaaataaagtgacatttccaaatgtcactaattaatagagaacattttgcaacattttaatgttttgtcatacttgataatttgcaaaaacaaaaacaaaaatatgataagactctccaaaatgtcaacatggctcttcataccaacagcaaaacgctgtatttcctgttaaaatacaagttaataaagaaaatagagaaactaaatactaacatatcatgttattttaataactatttaaatatgaggtgtggtggctcacacctgtaatcccagcactttgggaggctgaggcaggtggatcacaaggtcaggagatggagaccatcctggctaacacagtgaaaccccgtctctactaaaaaaaaaaatacaaaaattagccgggcatggtggcaggtgcctgcagtcccagctactcgggaggctgaggcaggagaatggcgtaaacccgggaggcggagcttgcagtgagccgagatcgtgccactgcactccagtctgggcgacagagcgagactccatctctaaaaaaaaaaaaaaaaaaaagagtaaaacataatgaaaagcatatgcttgcttggtgctaatgacgttttacagtcttatagatgaagcaacatgtgtaatttcaaccagatgttgaaatggtttaggattagtatctaaagacaagtatttcagaaaatatgtagaaaggtaaccatacacttgctacagggggtcctctatgcaactgtcttgactttgcactttatttttcaaaatgaaattataatctgttctgaataacatatatgttttaagttcatagagggagttcagcatagttaagagctcaggttttagagtcagatttttggctttattgcttactgggctataggatcttgagaaacttaaaactctctgagcctcggagtactcatttctaaaacaaggatggtaacagttaatcctgtcccgtaggatgtcgtgttgtttagattaagataatacctgtaaagtgctttccatggcatccaacacatagtaagtgctcaataaaaggtagctagtattattgttgctattcttactactattttttcattattactgttaataaaataatcacccttcaaatctaaaaacaaaataaaataggtttagaggaagtgagcacatgagagtagcaaggataggttgtggtcagagagcagagtactggatttcagaggtggagtggatgacatccaggctgtggtatgggagtttgtggctaaagtgcaggaaaggtaaaggtcactgtctggagttgaggttaaggaactgtaaggttatggtttctcatccacatgacggttaattatctctcagaatgaggacgggaaacaaggtagagaggaagaattggttgcgaagacttcactggatacaggaaaataactgggaagaaggtaacacagccccatcctgggccttcctgggacccccacccctctttttcccagttcttgctagctcacatctaacctactttgccttgcaaataaggagatcagaaaaaaagcaaaacaaacaaacaaaccaaacaaaaacaaaaacatacaaacaaaaaaaaacctgccctactatcctactatcatctcccggtagcacctcacgaacctgccttgggcacctactaagtgcaactttttgtagataatacaagaaggttaacacaactcctgtcccaacaccttttaatacagttgaatggataaaaacatggatacaaacacatggatataggtatcattgaagcagtgtgacataaaataacatctatatatacaacactcctctgcaaataacaaatgtaaagtaaaagatacccaacaaatcattttgtttatcttgctatcatttcttaatctataacgtctccctcccatgtatccatgcaaggaagcagtatcagctgcccgactagagggtagctccctcccttgggttacttttttttttttttttttttgtagagacagagtctcactctgtcgcccaggctggagtgctggagtacagtggtgcaatctcagctcactgcaacctccacctcccgagttcaagcaattctcctgcctctgcctcccaagtagccgtgactacaggggtatgccgccacacctggctaatttcttttgtattttagtagagacagggtttcaccatgttgcccaggctggtctcaaactcctgagctcaggcaatctgcccgcctctgcctcccaaactgctaggattacaggcgtgagccaccgtacccggccacccttgggttacttgagaccctactttcatttggatctgagctgtcctacccactcactgcaatctggcttttccttctttgagtataaagtcgatacgggatggctcgcctacagcttcagtgtttgaagtaaagaaagctttatgcagattctggcttttaatgggtctcctctgacagtagaaagattcaaaccacagccaattccaagaacccttctaagaacagagacagagtcacttcaaaggatctgacttgctatacctaaatataattcatggtgcttttcctatgacacaccataatattttgtccaaaaatcttgcaacatgttattaactttgaagaaagaataaaagcagccactttagagactggagacactcaagcactcatctattcataaagtttctacacagctgaagaagtttgcatcaagtggacaaaaaatagtacagaaaacctaaatacagaaaaattcagaaaactccatctcctagaaagcagggcaaggctgggcacggtggctcactcctgtaatcccagcactttgggaggcctaggtgggtggatcatttgaggtcaggagttggagaccagcctggccaacatggtggaacccgtctctactaaaaatacaaaaattagccaggcgtggtggcacatgcctgtaatcccagctactcaggaggctgaggcaggagaactgcttgaacccgggaggcggaggttgcagtgagccgagatcgcaccactgcactccatcctgggcgaaagagcaagactttatctcaaaaaaaaaaaaaaaaaaaagaaagcaagttaaatggactcagttaaagacctcactgaatgtaggagaatcaatgggaaacaacgtaaagccttctgctagggcataaataggaatccgtctatgtaatcaagaaattactttgcctcctgatctaaatgcttgcctctagtctagggcttagaaaaaggcctggttatttgaactggttgtcaatcaaggtccccttcattttcgctttcttggcttccaattcagcctagaaagaaaaaaaaagcatatgtcttgatacatgacatgaaattattttccttccttattctaaccaacccaaacactctcccttaatgttcatttagtgtacaaactagaatcatggttcccaaatcattatatacctctaacatctactttccaacctttctgatgttatagcacatacacaaaaaatgctatttgtaggcaaaatgggcaaaaagacaaggctgtggccacaggaaatcagcgcagggattccagcagccccagcgccccccacaggctgagggaaccaatactgtggcataccagtatgctattcttggcagaacaggaagaacatcattctacaacagtgctacttaaagttatatggtctatgaactatttgttattggtccacacaaaatatgtacaaaaatggatagtaagcatttagaagcttttatagcaatttgacacaatagtaatttttaaaatctgataaaaattgagacaattcatttttattgtattttataaattacaaatctgttcatggaaatttgaaaaaaggaaagcactggtctttctgcctttgaaaggttgagaagcactgttctaaacgactatggcaaggtaaagcagctcccaggacccaccacttctgtcaccaaaaactcactacagacacaaagagactggtatacctttggatgagacaccaacatagtgatatctgattttgatgaaatattttaagtaattgtcaaaaaaaaatacataggcaccatcatacacagatccatatgctctaagatgagcccatgaatagtgcagaaaaccaccagtgctttaagaagcaatgaccagccccaatcctggtactaccaaggtagccctatcatgtgccattacatcctgggacaacgtccagaaaccctgacctttaactcctgatcttggaccacaagaagcagattaaaatatcatcctggcctggcgtggtggctcacgcctgaaatcccagtactttgggagcccgaggcgggcagatcacctgaggtcaggagttcgagaccagcctggccaacatggtgaaaccccatctctactaaaaatacaaaaattagccaggtgtggtggcacgtgcctgtagtcccagctactcaggaggctgaggcaggagaatcccttgaacccgggaggcggaggttgcagtgagctgagaccacgccacggcactccagcctgggcgacaaagtgagattccagctccaaaataaataaataaataaaataaaaataaaatacagaaaataaaatatcatcctagttagggctataacaagtatcatcatttaaggcctagatcctggggtcactactacagagtagggtatactgacagtcacagaccagggttataaaactggcagccaactactctaaaacctcccaacagatttcctaaaagatttccctgcctgctgaaaggtctttcagaccaagacatccaaatgatagggccccagcaccttgctaccccttgctactcaccagctcttgcagtcgcctcttgctcatgcctttgcgctccagctgtttttcaatcactttggcattctgtgcatatgagtcagcaacttccctctgaaggaaaaaaggagcatccttaaaccggaagtctcaccaaggaataacaacaaagacgttaagtcataatgtatactactcaaatcatgaaatcatgactaaaatggcaggactctgttccttttccattctccatcttttcagtaatccaggagcacttagggtattttgtttgattgcttgtttgtttgtttgttttgagacagagactgactctgttgcccaggctggagtgcagtagcacaatcttggctcactgcaacctccacctcccgggttcaagtgattcttcagtagcatttacgttttaaccaaaacatatgtaaaacagcagatgacatcttgccatcaatatcgttatactgaagaaccataaaggtaattgctactactactgaggacagactcacaaaccacgagttgggctggaaggaaactgaaatctttcagtccagtagtttctcaaattaagagggatgagcactttgccctctaaggcatctctaaaaatagcatggaggaaaaaatcactgatctcattcaacatccaactccttcgttttcattttacagatgtccctgagatt[134 bp omitted]aagcctccacctcccgggttcaagcgattctcatgcctcagcctcccgagtagctgggattacaggcgcgcaccaacacgcccggctaattttttgtatttttagtagaaacggggtttcaccatgttggccaggctggtcttgatctcctgaccttatgatccgcccgtctcggtctcccaaactgctgggattacaggcgtgagccaccacacccagcccatagtttcttatcagcagagcagggtctaaaagtgaagtctctaatatttccactactccaaggctcccgctctagagtcccctttcctcgtacccttctccccaaattccagtttccttaagaccagagacacttacagcctcaatctcctcttcctcttcatcaatggtagacacggtgacagaactgaacttgcccatgtctttggtccgtttggtcatcatcacctggagtggcaggcaagaagaagtcagtccggttcaccaaaacaggatccatgagccgtgagtgtgtgcgcacacgcctgtgtgaggggctgtgggtattgggggaaacactacctctttgggacaggatgacctatttaaaagtgccaatgtttttatttacatatttttctaacatttgccatcaaaggctcttatttttttttaatttactttatttttttgaaatagcatctcactctgctgcccaggctggaatacagtggcacaatcatagctcactgcaacctcaaactcctgggctcaagtgatcttcctgcctcaacctcccacgtagctaggattacaggcatatgcccccacgcctggctaattttacatttttgtagagactgggtctcgcaaaaaaaaaaaaaaaaaaaaaaaaaaaagaaggacagaaggtataaaaaagcatccttaacgcttaatgtctcaggcttgtatccaactcctggcctcaggcaatcctcctgccttggcctcccaaagtgctaggattacaggcgagagacactatgcatggtccatcatgggttcttaaaatttatttttaattacttttttttttttgagatggagtctcactattgttgcccagcctgaagtgcaatggtgcaatcttggctccgtaacctctgcctcctgggttcaagcgattctcctgcctcagcctcctgagtagctgggattacaggcatgcaccaccatgcccagctaattttgtatttttagtagagacggggtttct[131 bp omitted]actgtcacccaggctggagtgcagtggcacaatcatagctgactgtaacctcaaactcctgggctaaagtgatcctcccgcctcagtctcctgaatagctagaactataggtgaataccatcacacccagccaatttacttttttttgtagagatagggtctcgccgtgctgcccaggctggtctcaaactcctggcctcaagtgatcctcccacttctgcctcccaaagtgctgggattacaggcatgagccaccatgcccagcttggaatatattttttaattagcctaattcattgtttttaattgttcaaaaaaaaatttgtaaaataacacatgatatctctccataaaaagaagaaaatttgaaggaaattaatgtgagtaaaaaccatacaatttctaaccttagtcatgaggcaactgtaggaaagagagaacacataacaggtgttacaattacatagcatctgtttatacacaaaaatggcacccgattaataaagaatgcatccatacacatgcttgaggggatgaataccccattttccatgatgtgattacacattgcatacctgtatcaaaatatctcatgtaccccataaatatgtgcatctatataccccccaaatcgtttttaacttttaaaaaataaaaataaagtataagaatatatccataaagaaaaaagaaataaaataagaaaaagacaaaaaaagaaaaagaaataaaaagaatacatccataaagagcagtttctcatcactataatcttatttcaaaacatgagctaaatctagagctatattaagcagtctctccttcaatggtaattaccttcttaggaggctcttgtttctgagtatatatgttcgttttcccaaagccctggccaaacttgactactgctccatccacaatgaaggtaacaggagcattctttggctgggattggtagaagagcggcagtccacacctgcaatgacacagtgaatttctgcgaggtctcataatccaaattcccaaaacagcaatttgcaaagtgtgcttagactctgggaatatttctgtttgtggcataaactaatgactggctcttctcagtgtctcccaaaactacctctacctgataagaatcacttaggccgggcgtggtggctcacgcctgtaatctcagcactttgggaggccgaggcaggtggatcacctgagatcaggagttcaagaccagcctggccaacatggcaaaaccccatctctactcaaaatacaaaaattagccaggcatggtggcaggtgcctgtaatcccagctactcgggaggttgacacaggagaactgcttgaacccgggaggtggaggttgcagtgagtggagatcatgccactgcactccagcctgggcaacaagagcaagactctgtctcaaaaaaaaaaattcatttttctggccagctggtcaaagatacaactttgactagcctctttggggaacatattggtatttgtgcatagttgaagtctgaaggcagttgataaggataaagacataatgggggtcggacgaggtggctcaggcctgtaatcccagcagttttggaggctgaggtgggcggatgaactcaggtcaggagttcgagaccagcctgaccaacatgttgaaaccctgtctctactaaaatacaaaaattagccaggcatggtggcatgtgcctgtaatcccagctactagagaggctgaggcaggagaatcgcttaaacccaggaggcagaggttaaggtgacctgagattgcaccactgcactccagcctgggcgacagagcaagactctgtctcaaaaaaaaaaaaaaagacataatggagagttgtatccaaataattattttcctaacacattatgcctctacttgcctatgcttggagaaacccacattgttaatacttactttgcacatttcttcctgtactgtcgttcaatgccttcaggtctgcacagaaaatggaagttaaaaagatatgaacaaatctcattatgtatcaaccttactatcccatttcttcaaacgctaagaggccctttcaaaagttttcatttgggggccgggcacggtggctcacgcctgtaatcccagcactctgggaggctgaggcgggcggatcacctgaggtcaggagttcgagaccagcctcaacatggggaaaccccgtctctactaaaaatacaaaattagccgggcgcagtggtgcatgcctataatctcagctactcgggaggctgaggcaggagaattgcttgaacctgggaggcggaggttgcggtgagccgagagcgagccattgcactccagcctgggcaacaagagtgaaactccgtctcaaaaaaaaaaaaaaaaaaaagttttcatttcataggtcaactcattggttcaacattcctcccttcctgcaacaaacatttatggagcccctgatacaggtcaggtatctccctgacaaaggaagaggaagaggaggagcagtgtagtcataatcataggtagcaatagtagttgtagtaataacaacaacaataatagcggcaaccacttataaaccctttactatgtgccaagagctattctaaagtatacatgtattaactcggctgggcacggtggctcacgcctgcaatcctagcactttgggaggcccaggtgggtggatcatttgaggtaaggagttcgagactatcctggccaacatggggaaactccgtctctactaaaaatataaaaattagctgggcgtggtggcggatgcctgtaatcccagctactcaggaggctgaggcaggagaatcacctgaacctggaaggcagaggctgcagtgagccgagttcacgccactgcactccagcctgggtgacggaacgagactccatctcaaaaaaaaaaaaaaaaagtatacatgtattaactcatttaatccttacaacaactctgtgaggtatgtcatattattattcccactttatgaatgaagaacctaggcccacagagtattacatggcttgcccaaagtcgtggagctaggaagcagaggttgaatttaagcccaggcagtcaagctcaagagcccacacaataccaccttagacaccaagtcatatacacaaggactcaattccacccacacggctgtttaacagaaacctgggactcatccttgattcttctcttcccctcatctcccacacttacttcatcagcaaattctatggatttttatctccaagaaaagaccttgaatctgtctgcttgtctccacgttcctgccactatcttagcctacaccaccattatcaactccctggacgactgtaacaaacggtcctgactggtctcttcacttcccctccccttgtttcaactttgtaataggcaatatatgcatatggtatacataagagtataaaacaaaaaatatcttccctactcatcctccacccacccagttcccttccccagaggcaaatactgtttctggtttcttctgttcatcctagagatagctgatgcatatataagcaaagaactctgactggtacataaagaaaatatttttttccttttttagacaaatgtacgctgttctctacttttgttcacttaaaaatataacttggttaaatatatatatatattccatatcaatagataaagagttacttcattctttacaaggaccgcattgtattcctttgtatagataaaccaaaatgtcttttacgtgttggacaaattcctagaagtgtgtacattttaaattctggtagatgctgccaaatttctctctatagaagttgaaccaatttagactcacactaccaatatactgagagttcctgtttccctacagtctcaccaacactggatgccgttaaattgcatcactgccattctcacatgtgaaaaatggaatcttttaatttgaatttctttttttaggagtaaagttacacatcttttcatatatttaatagtcatttgcattttctttgttttgaactgttagttcatgtcctttgtttattcagttaccttttaattttatattaaggaaacttgcaataattaaggggccttgtttattctctagtttgtcatttgtctttgactttttccaccatgtggaaattttaggtttttctgtggtcaaaccaatcttcttttctcacataataattcatacaattcaatagcaaataaataaataacctgattttttaaatgggcaatggacctgaacagacatttctccaagacatacaaatggccaacaggtatatgaaaagactaatcatcagggaaatgcaaatcaataccataatgagggccggacgtggtagctcatacctgtaatgccagcactttgggaggccgaggcgggcagattacttgaggccagcagttcaagaccagcctggccaacatggtaaaaccccatctctactaaaaatacaaaaattagctgggtgttgtgacacatgcctgtaatcccagctacttgggaggctgacacaggagaatcgcttgaacctgggaggcagaggttgcagtgagccaagattgcgtcactgcactccagcctggacaacagagcaagaccctgtctcaaacaaacaaacaaacaaacaaaaaaaccataatgagatatcctctcattccagttagaatggctgttatcaaaaagacaaggctaggtgcagtggctcacgcctgtaatcccagcactgtgggaggccgaggcaggcggatcacgaaggtcaggagatcgagaccatcctggccaacatggtgaaaccccatctctactaagatacaaaaaattagccaggcatggtggcatgcgcctgtagtcccagctactagggaggatgaggcaggggaatcacttgaacccgggaggtagagg[136 bp omitted]actgctagtgaaaatgtaaattagtacagccattatggaacacagtatgggagattcctcagaaaattatagaactaccctatgatccagcaatcccacttcttggtatatatccaaaggaaatgagttcagtatctcaaagagatatgtgcactctcatgctcattgcagcattattcacaacagccaagatatggaagcaacctaaatgtctatcaatggctaaatggataaagaaaaggtggcacgcacgcacacatgcacacacaacagaacattattcagccttatgaaaagaaggaaatcctgccatttgtgataatatggatggacttggaggacattatgctaaatgaaataagccaaacacagaaagacaaatactacatgatctcacttgtttgtggaatccaaaatagtcaaactcatagaagcagagagtagaatggtgattgccaggggctgaaggtggaggaaatgggaggttgttgtccaatggatataaagtttctgttgcgcaagatgagtaagttttggagatctaatgtacagcatcataactatagttaacaatactgtattgtacattctaaatttgttaagtatcctcactacctacacacacaaagaaaatggtaactgtgaggtgatagatacattaatgagcttaattgtggtgatcatttcacagtgtatatgtatatcaaaatatcaagctgtatcccttaaacatatacaatttttgtcaattatacctcaataaagctaaaaaaattaacacatcatattgatagaaggaaagagaaaaacataatcatttcaatagacacatagaaaaagcacttgacaaaagtcaaaaccccttcaatatactaagaatagaagggaacttcctctacctaataaagggcatctctgaaaaacccccatctgtttacccacgtcttagtgcattttctgttactgtaacataataccacagactggataatttataaataaaagagattgatttctcacagttctgaaagctgggaagcataagagcatggctccggcattgggcaagggccttcgtgctgcatcataacacggcagaagggcaagtaagtatgagaaagctcgattttaaaacaaagccgctcctgcaataacagacctactcacatgacagcaacgttaatccatgcataagagcagagcctcattaatccattcatagggcagacagattgtttccaacacatgaacttttggggaacacattcaaatcatagcaccacataaactaacatcatacttaatagtgaaagactgaaagctttccccctaaaatcaggaacaagataaagatgccactctcactacttctattcaacacctagaataaatttaacaaaagaagtgcaagaaatgtccactgaaaactaaaaagtattaccaaaagaaattaaagaagacctaaataaatgtaaacacattttgatgttcatggattggaagacttaatattgttaaggtggcaatattcctcgaatgaatttccagattcaacacaatccctttcaaaatcccagctggctttttcacagaaatttaagctgatcctaaaattaatatgcaattggaagaaatccagtagagccaaagcaatcttgaaaaaacaagaacaaagttggagaactcacacttcccaatttcaaaattgactaaaaagctatagtaataaagacagggtgatactggtataaggacagacatacaggtcaatggaatagaactgagagtctaaaataaacccatacatatatggttaactgattttcaacaagggtgccaagaccattaagggggaaaaactcagtctttttaacaaaaggtcctgggaaaactagatagccacatgcaaaaggatgaatttagccccctacctcatgctatatacaaaaattaactcaaaatgaatgaaagacctaaatgtaagaagtaaaattataaaactcttggaagaaaacatagctgcaaatcttcatatgcttggattaggcaaacatttcttcttttatttttgaaacagattcgggctgtgtcacccagtctggagtacagtggcacgatcttggctggctcactacaaactccacctaccaggttcaagcgattctctcctacctcagccccgagcagctgagactacaggtgtgcaccaccacatatggttaatttttgtgtttttagtagacatggggtttcgccatgttggccaggctagtttcaaactcctggcctcaaatgattcacccacctcggcctcccaaagtgctaggattacaagcatgagccaccacgcctggccatttcttagatatgatgcctaaagcacaagcaatggaagaaaaaaatcagatatatgggatgataaaaatttaaaacttgtgtgcttcaaagaatatcatcaaaaaagtgagaaaacaattcacaggatgaaagaaaatatttgcaaatcatatatatgataagggactagtatgcataacatagaattcttacaactcaacaacagaaagacaaatacaccaatttaaaaatgggggccaggtgcggcggctcacacctgtaatcccagcactctgggaggccaaggcaggtggatcacctgaggtcaggagctcaagaccagcctgaccaacatggtgaaaccccatctctactaaatacaaaaaattagccgggcatggtggtacgtgcctgtaatcccagctacttgggaggctgaggcaggagaatcgcttgaaccctggaggtggagattgtagtgaaccgagattgcaacactgcattccagcctgggcaacaagagcaaaactctgtctcaaaaaaaaaaaaaaaagaatttctacttcctctgtttcccctgtccttcctaaggttcccctccaacttaactggccagggcagagatgagggaggaacgaggaagcgggcaggcaggcagtacaactgaggcagatggtttattggtgaatgccagctgtttgggaaaaactctgtcaacctgggtttttcctctgatctcacaccacaacaacaaccttcaacacagaagaagacttctgtggccaaatgtgtgtgggtttttccccacactccaataaatggatgccagctaggtgtcctccaattcagttctgacactgtctactcggacacagcgtcagataccacaggttgacggcttggtccccaagaccggccactaaccagataccagtcgcaagtccaggcttccaaaactttttttttttttttttttaagactgagtctcactctgtgacccagattggagtgcagtggcacatcttggctcattgcaacctccgcctcccaggttcaagcgattctcctgcctcagcctcctgaggactacaggtgcgcaccaccacgcccagctaattttttgtatttttagtaaagatggggtttcactgtgttggtcaggatggtctcaatctccagacctcatgatccacctgcctcaggctcccaaagtgctgggattataggcataagccaccgcacctggctgcccggctaatttttgcaacttttttgtagagacagggtttcgccatgttggtcaggctggtctggaacccctaacctcaagtgatctgcccgcttcggcctcccaaagtgctaggattacaggcatgagccgccatgcctagtcaggcctccagaacttctgaccaaccagcttcaagttggggttcccacgaccccctctttgggttcgattactttgctagtgcagctcacagaactcagggaaatagttaatgtttaccagttaactacagaggatatcacaaaggatacagagaagagatgcacagggtgagctaaggggcaaggggcgtggagcttccatgccctccctggacacgccacccttcaggaacctccacatattcagccatccagaagcctcccaaaccctgtcctcctgggttgttatggaagctttgttacagaggcatgattgacaaccatgtagaaatgtgattggacaaaaagcacattatctaaatccagcaaggcctgtctgttcagacttttcttggcctctgtgcagcattcctttctctagggcagaggtgtccaatcttttgcacaatcttgcaaacatactaaaaccactgaatcatacactttaaaatggtgacttttatggtatgtagactataactcaatttaaaagaaactaaatctcggctgggtgtggtggctcacacctgtaatcccagcactttgggaggctgaggtgggcagatcacctgaggtcaggagttcaagaccagcctggccaacatggtgaaaccctgtctctacaaaaattacccaggtatgatggcgggtgcctgtaatcccagctactcaggaggctgaggtggaagaattacttgaacctgggaggcggaggttacagtgaacggagatcgcgccgttgcactccagcctatgtaacagagtgagactgtctcaaaaaaaaaaaaaaagtggaaaacagaaacgaaatctctgagggtaaagctgaggcattcgcattaaaacaaacaaacaaacaaaaaactcctccagatgattctggcacacagcaaaggttgagaatcactttgctaaggtgtacatgaaaagcagaatttataaggcacacattatatgcacctttagctatactggatgttgccaaagtactttccaaagtcattataactatttgtggtctttctggtactgtaggagacttccagttgctctttgacaacacatgggtattattttcccaattgaaggataaggaaattgggggcctaaaagattacttgcccaaagtcacaaagtggtactgcttgggatataactatacagactgtgctgaccatcatctttaatgttctgcctctccatttacaagtattacttatgtcaaaggtgctccaattcattgacatcactggaccagggcactaataatatttttggttctatataccctctctggtcccactgggactaaattcaaccccatactgaagggagagattcaccatacagagaatgaacttcccctagaatcctgaagtcggccaatcccgtaagttcaagctttcaaaacacatagaaatatcaaataaatggggccgcatatttctcaatgagttaatcttcaagtaccaatgacaaactggattttgtcaagtttataaaaatgtatctatttctaactatgtgccaagaagcaggcaagatgtctgtcctaagggtttcagaaaaataaggcagggttcctgctctcaaaaagttcatcttattgaaatagtgagactttaatgtaaatgaggtaagaatttcaagtggtatgacttaaagaagtgattaatatgagctagatgtttgggataattgaccttgattttctttcctatcctgaatctcaaggaatatatgaga[224 bp omitted]gaggcaggagaatcacttgaacccaggaggtggaggttgcagtgagccaagattgcgccactgcactccagcctgggcaacagagtgagacttcatctcaagaaaaaaaattctccattctggctgtggtagctagcctctaaggtggcccccaatgatccttgtccctggtactaacacccttgtatagtcacctcccacaatgaatagcgctgacttgtgacaccaaaaggacatcacagaaacaactgtgtgtgccttctgagtcatagccataaaacacattgcggcttttgccttgctctcctgaattacttacattatgggaagccagctgccatgtcatgaggatactcaagcagccttatggaaagatccctgtgttgagaaactgaggcttcttgccaacagttagcactcaactgcctaccatatgagacaccttggaagatgactctccagccctaatcaagatttcaggccaggcacggtggctcacacctgtaatcccagcattttgggaggacaaggcagggggattgcttgagcctaggagttcaagaacagcctgggcaacataggaagaccctgtctttacaaaaaaaaattaaaaattagccaggcatggtggcacatgcctatggtcccagctactcaggaggctgaggtgggaggatcacttgagcccaggagatcgagactgcagtgagctgtgattgtgccactgcactctagcctgcgtgacagagtgagaccctgcctcaaaaaaaaaaaaagacttcagatgactgtttacatagtcatcttcttaatcgcagcttcatgagagaccagaatcacctagctaagcttgctcttgaattcctgacccacagaaaatacataaaatgataaatgtttgttctttaaaaaaaaaaaaatcaagagagtaccagaagatgaagatggacagatcatagagcgcattcaggcttatatttttatccagccaactaggagtgttttccttgtactccacaatgatccctaaatgaaatcagatggggaggaaggaggagtccttaatggattgggctagactcctccccactcagagcagctttctgcttatcagtcttatttatacttctgggtaagaatttaattaaagaaaggatttttcatctaaaaatgtttcaaaggcattgctataagtgatgaagggtcactaacagatttgaagcaggtgactgacataatgtgtatttcagataattcaagcagtagaggatagactggaggagagcaaaactagagaccaaaagaccaggtaagaggccacttcagtagtctaagtaagtgattttgggtactgaaataacggcagtgcagcagggctgaacaggaggcagcagccacaaaagagattagaaggcagaatcgacagtacatggtgagtgactagatgtatgcaggggatgatggtgggatggtggggacagatgagacaaagagagactgactcctagatttctggctggggccactgcatgaatcctggtgtcatcataagaagaaggaaaagaaggactagcatttggctaatagtaatagagacctgactgcaatggcttcaacaaaagagcttgttctctcatgtaacatcaggaggaaggcagttctgagcactggttgagacccaaggatagcagggcaaaggctctgcaattcttgtggcctctccttcccagttccaggctggctgctagtgttccaattatcatgtccatttcccaagaagcaggatggaataaggataaagggtaaaaaaggcttgaagtcacccatcagctgacatctacttccatctcttttgcttggccaaagctaagtcatattcagaatcttagttgttggggggaaggggactggaatatgcacccta[132 bp omitted]tgaaaccccgtctctactaaaaacacaaaaaattagccgggcgtggttgcaggcacctgtagtcccagctactcaggaggctgaggcaggagaatggcctgaacccgggaggcggagcttgcagtgagctgagatcacgccactgcactccagcctgggtgacagagcgagactccgtctcaaaaaaaaaaaaaaaaagagtgtcagagtggtgctgagcgaatcgatctgtggtactgtccacagtagagaaatgataagtttggccttcatcatgttggatctgaaaagtaggacatcaggtgaagaggtagagtaggcaactggctatacagttctgggacacaggaaggcacagtaggcagatttagattttatcatcagcataaaagtgtaactaatgccatgtaaggtgacaagaatgcccaaggaaggcataaagagagtggggacaaaagcaaggtcagaaccgcatggaataccaatacttgaggggcaggcagaagaaaaagaatccaaaggattgagaaggccaaagaaggagaaggaggctcacaagagcagcttcacgtgttgaaaccctgtctctactaaaaatacaaaaattagccaggcatagtggtgcacaaccgtaatcccagctacatgggaggctgaggcaggaggatcacttgaacccaggaggcagaggttgcagtgagctgagatcgcatcactgcactccagcttgggtgacagagcgagactctatctcaaaaaaaaaaaaaaaaaagaaaagaaagaaagaaaacatgtagctagatgtcagcctatagtttttttctggttcaacactaaagtttcataagggcaggattctttgctgtttactggttgtactgggttagatagtgacccttaaaaattcacattctggccgggcacagtggctcatgcctgtgatcccagcactttgggaggccgaggtgggaggatcacttgagtccaagagtttgagaccagcctggccaacatggtgaaaccccatctctactaaaaacacaaaaactagccaggcatggtagcacacaccatctcaaaaaaaaaaaaaaaaagaaaaaagaaaaaagaaaaaaaaatccacatccatccaggaacctcagaatgtgaccttatttggaaatagtgatgttgcagacataattagttaagttaaaatgatgtcatactggaggaggatgggcccttaatccaatatgattggtgcccttataagaaaagaacaggcaaagggagaatgccatgtgatgatacaagcactgactggagtgatgcatttacaatacaagccaaggaatgccaaggattgctggtaaacgccaaaaaccaggaatgaggcaaggaaggattctcccctacaatcttgagagagagcatggacttaccaataccttgatttcagacttctagcctccacaactattaaacaacttctcttgttttaggccacccaatttgtagtactttattttttttttattttttgagacagtgtctcactctgtcgcccaggctggagtacagtggcacaatctcagctcactgcaacctctgcctccccatacaagcaattctcctatcccagcctcccgagtagctgggattacaggcacacgcgccaccatgcccaactaatttttgtatttttagtagagatggggtttcactacgttggccagcctggtctcgaactcctggtctcaagtgatccacccacctcagcctctcaaagtgttgggattacaggcgtgagccaccacacccaggctgtagtactttactatggcagctctagaaaactaatacactggcggccgggcacgatggctcacgtctgtaatcccagcactttgggaggcc[210 bp omitted]tgggtgacagagcgagactccgtctccaaaaaaaagaaaactaatacactggtatatattccagacttctaggatagtacctggaacatagtaggagctcggtaaatgaaatatttgttgcatgaatggatggattttttaattccctaggattgacctttccatgacttctagcacctgctgctgaccgtcccctagccacacccccacacacttcttgatactctctcctattttctgcatcaccaggttcttctggttctgttccaattcttttgtctgccttttaaatattcagtcctatctgcttgctccacactctgtaattttatcccttcccaggtttcaatttcccatatataccaaactcccaaatctaaaacagagctaaccacatcacacccctgcttaaaaaacagagataggccgggcgcagtggctcacccctctaatcccagcactttgggaggcagaggcaggtggatcgcctgaggccagaagttcgagaccagcctggccaacatagtgaaatcccatctctactaaaaatacaaaaaattagccaggcgtggtggcaggtgcctgaaatcccagctactcaggacgctgaggcaggagaatcgcttgaacctgggaggcggaggttgcagtgagccaagatcacaccattgcactccagcctgggcaacaagagcgaaactccgtcaaaaaaaaaaaaacggagatggctcttcattgcctacagattaaggccaaacttgtccacttcagcactttactctgtcctcaccctagtatgcatgatgccgttcctgtaaagtaacctgtgctccagtcacaaacgacaattcaggtttctaaagcacaccatgtttgatgcttttaatgcttccatattccttccacctggaatgctcttcattcccttcatctacttggtgaaatcctagttcaggctaaacacaaatgccatcatcttttgaagcctttcctggccaccattcaggacaaatgacccactcccacctgtttttcctttcgttcagaagaccagtattttttcctatcacaataggagtcattccctcaaagtcatgagctctttaatggtaaaaatcataccttattcatcttcacagatccagtacctagctcagtgcctggcacacggtatgctccacaagattacaggttgaatgaactcattcaaacctgtaaattgtaaacaaactacggctatcaaatggcaatggaggggccgggcacagtggcttatgcctgtaatcccagcactttgggaggccaaggagggagaatcacttgaggccaggagttcaagaccagcctggccgacatggtgaaactgcgtctctactaaaaatacaaaaattagctgggcgtggtggcgcacgcctgtcatcccagctactggggaggctgaggcaagagagttgcttgaatctgggaggtggaggttgcggtaagccgaggtcacaccactgcactccagcctgagcaacagagtgagtgagactccatctcaattaaaaaaaaaaagcaatggaatcacatgtgagcaccatttcaacaaagcacaataaagatattactacattaacagaagttagaaaaccaccacaaatgtcaaagtattgggaccaactgacctgttcaacaatagatgtgatatttatattattcagaaacagactccaacacaatagggaaatcctaaacagggagcatcaacctcttacctccgcagatacatagtctcctcatcttctgtgttacaaaacttatgggcatgtttggcagcatcaatcacacgggaccggtcccggggcctcatgggcaatttctctaactggcagtctgaaggaatggagagatttggtcactagagtcatggcaaaatatagcaaatgagtcactgcaaaatatcctgagaagttttgagtgggatccctagcactagaattttctactacaattactatgcttattgaaacctattattgaatgttccaactaaaaatgacttgctatcaggagaccttggtatttggacccagctctcttactaccctggtgatctttggcaaatcacttcctcctttggagacttttgcctcatttgaaagatgagttagatgatattatctcaaaagtccttcccaatactgcaattcaggtttctgtaagtatttctgtgatcatagtacacttggtttgtgttataatgcattagaatcaggagacacaatcaagcatactggaatgcctacaaggaagcactgggaaaagtgggtatgtgctaagaaaaggagagaggctgggcgtggtggcatgcacctatagtcccagctactcagaagaatgaggcagggcgattgcttgagaccaggagtgcaatgctgtagtgttccatgattgtgcctgtgaatagccactgtactcctgcctgggcaacacagcaagaccctgtctctgttttacaaaaaaaaaaaaaaaagaggccaggcgaggtggctcatgcctgtaatcccagcactttgggaggtcaagacgagcagatcacctgaggtcagtagttcaagaccagcctggcccagctacttgggaggctgaggcgagagaattgcttgaacccaggaggtggaggttgcagtgagccaatattgtgccactgcacttcagcctgggcaacagagcgagactccgtcaaaaaacaaaaaaaaaggaagagagagggtgattatatagtatgcaaatgatccatcctagttggaggaattttaatctgaaaacaatgaaaacacagtaaacaaattaggtacagttgtaaagcagattgaaaattgatataatgggccaggtgcggtggctcacgcttgtaatccagcactttgggaggctgaggtggcaggtggatcacctgaggtcagaagttcgagaccagcctggccaacatatagcgaaaccgtctctactaaaacatacaaacattagcagggcgtggtggcacacacctgtagtcccagctagttgggaagctgaggcaggagaatcgcttgaacccaggaggcagagggttgcagtgagctgggatcacaccactgcactcctgcctgagcaacagaggaaaactccgtctctcaaaagaaaaaaaaaagaaaaaaaaagaaaatttatataatgcaaattaagcacctaaaggatcacagagaaagtcaagtggtcagagtaattcaagatgaatagaggaggtgaagagaggagttagagaacactaggcagtttacatgtcagctcatttactcttcacaatgaatggttaaagtaaagatttgttgttcctattttaaagatgaaggaactgaggttaaaaagggtaagagatataccatgcatctaataagaagcagaacaagaattcagacccaactctaagtgattcaaaagcacatgctgtttccaccacacctccttaccaagaattaatttcttcgataaatacgtgagggccctctaggtagcaggcactgttctaacactgtgct[135 bp omitted]caacatggtgaaa[131 bp omitted]gaaaccctgtctctactaaaaaaatacaaaattagctgagcatggtggtgcatgcctgtaatcccagctactcgggaggctgaggcaggagaatcgcttgaacccaggagacggagggtgcagtgagccgagatggtgccactgcactccagcctgggcaacaagagcgaaactccgtctcaaaaaaaaaaaaaaaaattagccagacatggtggcaggtgcctgtaatcccagctactcaagagaatcacttgaacctgggaggcagaggttgcagtgaggtgagatcgcaccattgcactccagcctgggctacaagagctagacactgtttcaaaaaaaaaaaaaaaaagttccggccctgatgaagcttacattctagtggaagaggcaacatattttaaaataattataatatgattttgggtaatgataagtgctaaatattaagcagggtaagaggacaaagtgacagggatgctgttttagataaggtaatcagggaagggttctctaaggaaattacattttagcagagacctgaatgaagtaagggagggattgagggaaaagtttttggggcagaagaaataccaattaaaaaggcactggggggcaggaacacttttgacatgatggagaaaaagcaaaaaggccactgtggctgaagtgcgatgagcaagaggaagactgttagggaatgaagcctgagaggtagccacaggcctgatcaagggtcttggtatggatggactttggttttattctcagtgttatatgaaaccattggttttgaacaggactctggctactatgtggaaaagagtggaagcaacgagagcaagagactattgtgccaatccaggtgaaagatggtagtagcttggactacagtgttagaagtggaggtggtaggccggccgtggtggctcatgcctgtaatcccagcactttgggaggcctaggtgggtggatcacttgaggtcaggagttcaagaccagtctggccaacatggtgaaaccccatctctactaaaaatacaaaattagccgggcgtggtggcacatgcctgtaatcccagctactagggaggttgaggcaggagaatcgcttgaacctgggaggtggaagttgcagtgagccgagatcgcaccactgcactccagcctgggcaagaagagcgaaactccatctcaaaaaaaaaaagaaaaaaaaaaaaactagccgggcctggtggcgcacactacttgggaggctgaggcaggagaatcgcttgaacctgggaggcggaagttgcagtgagctgagaccgcgccacagcactccagcctgggtgacagagtgagactccctctgtctcaaaaagaaaaaggaatggaggtggtaagaagcagtcagatcctgcatacattttcacgaaagcacctgcaggatttcctgatggactggacagatgtaaggtacgtgacagacagaagtcaagactgattccaggttttggtctgagatactggatgaatagttgtactactgactgcaatagggatgactataagaggagcaattggagagggggtgtagagggtcatgaactcaattttcagcacgatatatttgagaggcccattagacattcaagtggagatgttgaataggcaattggagtctcaggagaggtgcaggttaaagatgaacatctgggagttaccagcatgtcagttgtatttaaagcttgggaatgaatgagatcacctagggggtgggtacagagtgagaacaggtgagagtactgagctatagggccttggaatgcctaaaagtctgagagagaaaagggagccagacaagg[137 bp omitted]acaaaaattagccgggcatggtggcgggcgcctgtaatcccagctactcgggaggctgaggcaggagaatcacttgaatccgggaggcagagcttgcagtgagccgagattgcaccactgcactccagcctgggcagcagagtgagactccatctgaaaaaaaaggggggggggaaatacgaggtaggaggaaaatcaagtgagtatggagtcttggaagcaaataaaaaacatgttgcaaaaggaatgaaatgattacctctgtcaaatgccactgacagaattaaaatgaacattgataactgaccactagaactgttaacatggagccaaatacggttaagatgatgaggtgggaaggaaagcctacctgaagtgaggtcaggagagaattagaagtcaggatgcagagacagccaatataggcaactcttttgagaagctttgctataaaagaagcaacgaaatggggttatagctggaggggaatacaggatcgagggagggttttattttcgtttgctgtgaggtaagagcaactgcagcatcttggtatccagcagaaaagttataaagcttctagaggcagtagtttttgaagacagtggattaagagggaaatacaatatgtttgtgtttctatttttgttctcctgaaggagtttagttttgaggaaggtctggatacagagtcacaaggctaaacaaaaagcaggaaaaaaaaaaatgccctggagtggggcggggatgcgtagggaggatttagtcggagagagaaaacccaccaatcttcgttgagaagtggctcccagatcacagccagaggaaattcgccttcaagaacccgaagtctggctccttgcagacgcccccgcagttcccggctactcacccagcactaggaccatctggccgcacaaacagtagtaaacatggaggggcttctcgccgtcgtcatattcctcccggtcccgagtgtcagagcagactactgaccgagacactactttcggcatgattcccaagagcaatctgaaaactctacgccaagaagagggtcgccccgaaatgacgtcacgagtgcgccttgcaccttttccttgtggctacgctggtcacgtgttagcagaagtcttataaacttccgggctgtcctatcaggctaagatatacgggggtgcgcctggagcctcccagaacctactttgtcttggccaagttagctgggactcctgtgatctgggagtcacttctcaatgaagattggtgggctttctcacaacacccttaatattatataaattctttacatttctataacgcatgcatttatatgtatatatacacatatgtatatataagaccagctaaataaaggactatgcattatatagtttatattatatatatatatatatatatatgatactgatttgggtgtgtttctaaatatgattgtgattttaatgactattccagatgagtacataattttttaggtatcttattttttagttgatataattcacgtaacataaaattcacccttttaaaatgtgtaattgggtgttttttagtgtattcacaaagttgtgtaaccatcaccactaattccagaacatttccatcatctcaaaaagaaatcttatacccattagtagtcaccacgacccgcacatcccccaccttcccagcccacggcaaccactaatctactttttatctctatggatttgcctattctggacatttcatataaatggaatcctacaatatgtggccatttgtctggcttctttcatttaccataatgttttcaaggttcatccatgttacagtacttctttcctttttatggttgaataatatttcatcatatggatatatcacattttgttcattcatcaattggcagacaacggggatgttttcactttttggttattatatagataatgctgctatgaacattcatgtacaagaatacttccaccgcaaatttgtgtgggaatataaatctggatttttaacttttgacagcacgagaagtgattaaagcaccttgacactgtttgtgattcaaacaatgtgggatgtcattgaatgactttactgcagtacaggtttcaggtataaacactgttttgccttgtaattttaggttaaattcattaaggaacattactaagtctatggcaaaagccattttttaaaactattcatgttcaataatagtggtcaagggtggggttcttctcatttagaaaattttctaaaattttgaattcaaattcaaattcaaattttctaaaatcttgaactcctgacctcgtgatccacccaccttggtctcccaaagtgctgggattacaggtgtgagccaccgcgcccagctgaacttcactgttgacactactgtcaagaataacacaagacagattcaagtttgtttgtttgtttgttgcaaagtacctgctgtttaataatacaattaataactacaggattttaaacaacttacattttgacaagtattgtacatttgtctaaaccttttctgctccatacatatttgtaatacatcttagcaaattatgctttagactgaattgaattagtgttttcctgacttctttg[135 bp omitted]tgcaacctccaccgcccaggttcaatcaactctcctgcctcagcctcctgagtaactgggattacaggcacatgccaccatgcctggctaatttttttttttttttttttttttgtatttttagtagaggcagggtttcaccatgttggtcaggctgatctcaaactcctcacctcaagtgatctgcccacatcggcctcccaaagtgctgagattacaggcgtgagccaccacgcccggtccaattcttcagtcactttaaagtcaacattgactccttgagtaaaaaacaacaactgagtaatattggtaaacattcatcaggagccaaggaaaaccacttgaaatcatttgctttgtttttgtttttgtttttgagacagggtcttgctctgtcacccaggctggagtgcagtggcatgatcacagctcactgcagcctcaaactcctgggctcaagtgatcctcccaccttagcctccctagtagctgggaccacacatgcacaccaccacatcggctattttttttttaatttttttgtagagacaaggtcttgctgtgttgcccagggtagtcttgaactgttgggctcaagcaatccttctgctgcaggctttcaaagtgctgagattacaggtgtgagccaccgtgccttgcccttttttgtttgtttgtttttgttttgatgttgatttcaatgtcctcaactcttagagccactgttcttgctgaaaggtgaatagtcttcacaagttttatttttcttgagcctatttctttgacttctgcagccaaacacaatttagctcagtatcagtaaatgactttccttggttggctaacaaaggagccactcagaaacttactttgactataggcttatttttattttttcctttttggggggggcgggggatggagtctcgctctctcgcccaggctggagggcggtggcgtgatctcggctcactgcaacctccacctcccaggttcaagcaattctcctgcctcagccccctgagtagctgggattacaggcatgcgccaccacactcagctactttttgtatttttggt[136 bp omitted]ctgcctcagcctcccgagtagctgggactacaggcgcccgccaccacgc[174 bp omitted]tggaactcctgacctcatgattcacacacctcagcctcccaaagtgctgggattacaggcatgagccaatgcgcctggcctattttttagttttattatgaattttgccataataagatattctacttaaaattttaaattttactagccattgctctcctctgagttgggaatattgtgatgaatgcttagtctggtaacattgatgtacattataatattattaaatcttttgacttttttcaaccgtttaagaatatagaaagccattcttagtttgtaggccatagacaaataatggcaggttagatttggctgcagtttgctgagccctggtctgatggatgtggctggtttgattgaattcccatgtacaacatggtagacatgtgtattagtttcatattactgctgtaacaagttaccacaaacttggtggcttaagacaacacaaatgtattatcttagagttttggacatcagaagtccaaaaccaatatcagtggtctaaagtcaaggtgtcagcaggtctgattgcttctgggggcttcaggcttccatcttttgcctcttccaactcctactgcagacatactttggctccttccctggtggccacatcactccaatctctgcttcagtcatcacatggcctcctctttgactcctacttcatccctcgtataaggactggtttgattgcctcaggcccacccctttaatccaggataatatccccatgtcaagattcttaatttaatcacatctgcaaagtcccttttgccatgtaaggtaacatattcaccagttacagagataaggaaatggagatctggctgggggggcggagggggcagggttgtgcattattcagcataccacaccatgcctttgttttctttgattcagtaatttagcaggtagtgaaatccttttttttttttgagacggagtctggctctgtcacccaggctggagtgtagtggcgtgatctcggctcactgcagcctctgcctcccaggttccagcgattctcctgcctc[203 bp omitted]gccttaatttccccatttccctcagctttgatattcccctccctccatcccaacctctttgtctctctctcttccccccaccacttatgtcctagaggctgaagatgaacaacatactacaagttgtcaagagcaagagcacacactttgctaactgttacttcctaaaagtaattctcttgaaatattttctgagattatttgagtcaagaaagacctttcgattttattttctgttggtgctttgttgctgtttgtactaaattttatcaacagaggtgaaaaccgtaggaaagtaaaagtcctttgccttcactggataacagaaatacaaacttacagcctgataaggcaagaaatgatctttaatttcgtctcttctcctaacccaaaatacttcaggaaaataaaaatctatttttcatgttgaaatcttcatgaatgaaatttcacaatttttttggtttttttgagacaagtcttgcatttttgcccagactgatctcaaactcctcacttcaagcgatcctcccacctccacctcccaaaatgctgggattacaggcatgagccactgtgcccagcccacttttctttaaattgaggagacttatcctttctggacccctgctcttgggtaggggtggtgcttggctgtgaagagggtatttcttcaagatgtcaaggtgaaaaaagggtagaaagaatgcttggccaaactgtgctaaagttagtatgttctagcctgataatcatcatgctggaaaacaatcttctgtattgctgcttgctatgacaaccctgcttctgctgaggaatgtgggggcacggtgttcctgcaatgcagtttcattccttagtcagagaatgctactcccatgcaggtgccagggggcttccaaccatttgggtcatgctcctgagtttttttgtttgtttgtttgtgttttgttttctgagacggagtttcgctcttgttgcccaggctggagtgcaatggtgcgatctcagctccctgtaacctccgcctcccgggttcaagcaattctcctgcttcagcctctggaatagctgggattataggcatgcaccaccatgcccggttaattttgtatttttagtagagacggggtttctccatgttggtcaggctggtctcaaactcctgacctcaggtgatccacttggcctccccaagtgctgggattgcaggcttgagccactgagcccagcccttagttttcttgaaaggaagaaagtccaagaaaggaagagaaagggggtttcaaaaaacagacaagctcacaacaaacttacatacatctatatccttcaataaatttcagacatgtatatccagtagcaggagcttctcagtccctttcatactttttagtacggtacatgccgcttcttaatagggtattttctttttctttctcttttttttttgtctggtcgtgtcgcccaggctggagtgtagtggcatgacctccgctcactgcaacctccgcctcctgggttccagcgattcttctgtctcagcctcccgagtagctcgaactacaggtcctcaccaccacgcccagctaatttttttgtatttttagtagagatggggttacctcatgttggccaggttagtcttgaactcctgacctcaggtgatctacctgcctcggcctcccaagtgctgggattataggcgtgagccaccatgcctggcctcaaaagga[137 bp omitted]gcctccagagtagctgggactacaggcgcccaccaccacgcccggagaattttttgtatttttagtggagacggggtttcaccatgttagccaggatggtcttgatctcctgacctcgtgatccacctgccttggcctcccaaagtgctgggattacaggtgtgagacaccgcgcccggccaggatattttcaatacatctctctcatgctcaaacacctataaaagctgcctaaattccccattctcgcatttgagggcatttaatcaacttctgtcaccctcacttttcctagctgaggtctcatcattccccagccaagaacctgtccattagccaagctcatctgcccacgggtttagctccatgcccttgtctgtgccattgcccccatataaactgcttaagttcttctctctcaagctccgctttcatctctgttgaaacaaaattgaaatacacccatttcaggaagcttgtcctgatcccaccagaatgacgattcctctgctgtgcaatctctcagcatctgtggtttcacacacttctacaagttgaggatctcaaatctgaaaatctaaaatccgaaatgctccaaaacctgaaacttttataatgcaaataattccaaaatctgaaaaaaaaaaaaaaaaaaaaaggaaatctgaaaccgttctggttctgctgttgctgtcgtaggcagacttctaagatgctaccctcccctgagattcttggtccttggtatatacacacactttctcccagttattaaatgaaatactaatctaggttctgcagtgaaaaaatttagcagacataataaaggtcccaacttagatgtttttaacatagggaaattatccatggggtgggcctgacataatctgataagcctttaaagtagactgtgctcttcctgaaaacaagattcaaagagtgagagggatgtggtgggagagaaattctctgttgatgactttgaagatggagtaggccacttggcaaggaatgcaggcggcctctaggagctgagagtagttcccaggtggcagctagtaaggaaatagggaccaaagtcctacaactgcaatgaactgggcttggccaacaacttgtaatttgttaagcagtgatgaaaacgaatatacttgcttttgtagatcttgcttttgttgatttcatatgtgtgtatgtgtgtgttagtagactgcaagttcttagatgagaggaaaaaaagttttttttttttaatttttgtacccccttcctactacagccataatgtgatgctattagggagacttgccttaactgatatgttggagttaatgggagatagaaatccttgaccatgaaagtacctgttgttaagcagcagctagaatcactaccattgtcaagtgcctcctgcttctcatgttagaaacaaattcctgcacatctgatatcttctggacatcttcacggggatgtctcaccagtcccatgaactcagtaagtcccacccaaaatttccttttccaaacttgtccctctctctctattctgtaattctgttaatggcaccttcaaaaccccagttatctcggggcttagagtttcagccactgttgactccttcctctctcttgccccatattcagcctgttgccaagtcctccccattcattcatatcctcgcctttattgtcactgcctgcttcagtatctcgcacctagatactgcaagagtctcctgcctgctctcttgagaccaatctctgataaggacagctctaatgatgtcacttccctgctcaatggacttccaaggaatccattagcttggcattcaaaactcttgatgacttaacccaaatctacctttctcctattttcaataatttttaaatgtgtattatgcctatcttctaagttattttgggttgacctttaaaaattatcctttaaaactgttattgcttttgcaggtccacggactgtgactcttcctgcaacctgcagcttttccacgttccttttacttcagacccactgtccttgcaactccctgcagtcggatagtctcatatcttggactcttctgaacataaatagccgcttggcttgttgaactaccaaggggaaatgtggttccagagccaaattgtgagtgcccaaaacaaaacagaacaaaacaaaaccctactccgcctgccttaagctcccattccctcccacaggacatacaacactatttcattctgccctggggtgatcattggcctaaacgttgagcgcccaatcctgcattcaatcccacagccccgccccgcccccccgtcatagtcaaggccgatttattcttttgattttccgtgattttaaccaatcactcctctccccacccctccgaccccagtctccggtgtccgaaggggttgtgcaccctagagttgccgctttttgagaaccggttttacctccgcccactccttcgtcctctagtttgggacttccaaacttctcccctctcctccccgggcatagtgcgcgctttcatgaatgatctggtcacaaaacaaacaaaaacgaatagaaaaagaaaaaaagagaaaaagaaaaaaagccgaaaacttcccagggtttgccttagaattagcaggtggggatggaccccgttccaccacgagctcctccagcgcccggggctccggcgtaccctacgcctctgcgctcgcggccccgccccgggcctcccgtggggctttaatgacataagcaactttcctcgcgcaccccccgccccgtcttggtacggcctgtccggcgctcgacgttccacccccctctctctgctctcaggttggttcagcccccgtctacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggtaaaccgaggggacggccgaggccgggggttgcgagctggggcacagggcgggtcccgaggcgcgccgggcggggagggctggggagcggccgggagcgggcgccagtgccggcctagggggacccctgtctgtcttcccgaaggttgcaggaggatcctccagccggagtcagcggggctccgtccgagaacaacataatggtgtggaacgcggtcattttcgggtgagtctgcgttcgtggcggtggcgagaaaactggggacgcgagcagcttcggtctgcgctccggggcgggccccccgcggaggccgagcgggtaggggaaaatgtttgggtctggctgggcctaggcgcctccccggagcctgtgcctcgattagctcagttcccgctgccagggggaaccgcttggggttctaggggggcggggcggggagtggtggcggttaggcgcggcggcttgccctgtgtctctgagcccgggacatccatttgtagtggcttccgaccccggtagcggtgctggagatggcagagctcgggatagccatctcagatgaagcagggagaagggggccccttaagtgggaactgaccatttttctctgtgttgcaggcctgaagggaccccgtttgaggatggtaagagagagtttctttacccacttttcaggagcctggtcatctggggaaagggttcccagtcatcctggaagtgtctcctgcttaggaacctgcctctgcctagcctctgtctgctaaaggcttgagtggaatgcagtgtgtggctggtggttctggatattgtatgcttgactagaactgcacctttcttcttgctttcttaaaaaaaaaatctgtgtaaggcagtcactttttaaaaggagcaatcatagcactggtattaaggatttttgaggcttgggctgtaattctgctaaattcagccctccatcactgaattagtataaacccaaccagttgctgataggcagcagagaccccagagaccatctggttcagaattctaccccaagggcaggagttgtgttcagcaggtgcttggtagatgtgtgttggatgttgagtggatgcgagaatcccttgcgtacaactgtctggtttctacaatctgacattgaatgcctgtcagcctcactgctctaagatggtcttaaatgcctcatttgagtacagtattctttcttatttttaagtgaatttgcagtgtgtgctttcatcaagacgttatgatgagtaatttcaaagcagcttcacaattgaagttagccttaatgtacccttttgatcagtgtcctgcctacctgaaagtactacatgtaccagtaggtacataatttttaattgatttaggtttaacttttaaaaacacgtgtaaattgctttttaaaaactttctgattttagataattatagattcatatgcagttgcaagaaataatagagacaccctttatacccttaacccagtcctctacccaaaccctcccatttggtaacatcttgaatgactagaccctatcacaaccggaaaaatgacactgatagttctacactcagttgtgtgtgtgtgtggttgttttttgaaagtttaatacatttaaaggatgattaaagtatttgaactcatgaaattctttaatatttgaggttttaaaaaaaaggaaaaggatctttctgttatttttttcctcaatgatttccttcggtcacatagcatttatacacacacacacacacacacacacttcagtttgaaggtgggaacaaaaacatttctgcaaactacttaatacatacttatgttgctgagccggattgctttttgatgctaccagtccacaaaatgttgtgaggtaagtcaatttcaactaagtctgtaattcatctcaagtacttagatttccccaggaaactgtggacagtcacctgaatatttttagcttcctctttacctttaccccctgggtaaatatcattactcttcagggctgcaaagaaaagaaatgacagcaggaaacagtgattgtaagggcatactactttggcgcagttaatcatttgaactgatttgtagcaaaaaactatagctagacttaattttcttctaccagattggcactagtttttttgtttgtttgttttttgtttttgtttttttgagacggagttgcgccctgtcacccaggctggagtgcgatggtgtgatctcggctcactgcaacctccgcctcccaggttcaagcgattctcctgcctcagcctcctgagtagctgggattacaggtgtgcgacaccgcgcccggctaattttttgtatctttagtagagacggggtttcaccatgttggccaggctggtctcaaactcctgaccttgggatccacccgccttggcctcccaaagtgctgggactacaggcttgagccaccgcacccggcgagcactagttctttatacctgagctttaaatgtacagattaactgtgtttgctttagctctagtaggccttgttttcattggcttcttttttcctcgttttactctgttttatgctgggcacagctttattaatagtacatcactttgctggggattggctacctaaatatttcaagggtgcttctcttaagtggtatgaattgaaaaggtacttacagagtccattatctaccaggactgtcacctttgacattactggttctatttttgatgatgtgtatctccatcctagcattactgaaaggaattactcaggctgatttgttctgttgaacagtctgctaccgatggatgcttcctcaggtgtctggaacactgtggcctgtggttcccccacaaaaaaaattttagcttttttttttttttttttttttgagatggagttttgctcttgtcacccaggctggagtgcagtggcacgagctcagctcactgcagcctctgcctcccaggttcaagcaattcttctgcctcagcctcccaagtagctgggattgcaggcacctaccaccatgcccagctaatttttgtattttttagtaaagagggggtttcactatgttgggcaggctggtctcgaactcctgacctgaggtgatccgcccacctcggcctcccaaagtgctatgattacaggcatgagcagccgtgcccagccttaaccattttttgaataccctttatttatagttggggaatttacagttagagaaaagactgattagggataagtggcatagttgattttgctgtttccaatgtattatgttattaattaagaaccccaaaactacttttgcttctttgttgtaaaccgttcgttatggaagtttctggaacaaccaggtcctagttagagtgatgaaatcttaagacaagcaacacttaagggtattttggtttaacttcacacactcgaagtaagaggaatatattctcaagagcttacactaccaaaacattggggagaaatgcttcctcatcagaatatcttggtatacatgctaaatacaaaggttatggaatataatcttcatcacataatctaaaaattgttaatagacatggtaaggtactggtatttgcttttcataatagatgtgttctttagaattggggtataaatcgtttttatttttttttaatttttggaaatgtttctgagtcataaaatctttttcaaaatgaatctctaaagtccactaagagtgttttaaatataaataaatcctatgatgaagagttttggatattacttgaaaaatcgattttcagtcatcaaaaataattttgaagttatatgtattttgctttcttctcaggggtcacaaactggtggccaaatggcagaaaacacctgcaggtgtgttttctttggccaacacagtattttccaaaacttgactttgtgagtgtctttaggcagaacatataccccctctagttcaaccatatcactccttattgccatacaccagtcacttaacacgtttatgtaattttggtggtctccctgtatagatggattaattgatactttccttacgatgtcttagcctcctcgggaagatgaacaaaattagtatacattatgtacaacaatggtgaggcttaaattttcagttattttaaagcctagccttctaaatattcagagggtaagctgtagtctcaagactgcataatactaattctgggattttaaattcccttaacatttgttttagagcttagaaattacattgaaggttatactaaacaggttctgattagtgtgactaaaagtgtgaagtttttaccctctttttaatgtgtaccttgaataagatttgggttgtcttaatttatattcaagtagacataaataggttgcttcacttctcaagatattaagtgaactgttttaaaagacttgcgattaacttctttggtagctaggtaatcacttagttgaacttctgggcaagtgtatgcagaaagctcaagtcaaggaacttgtgagccaccaatataggtactcaacttgctttgaactgtgagtgtttgatgtagacctaaaagtactgtttaatatctgaatgccttaattgtatatttcttactgatagttctgatttttgggttttgcctccttcagctgagtctagagatgtgaaactttagaattattatagcaaaaatagttgctcatggttttggagcacttaactttgtggaactatgcatattcctctcatttaaacctcacaacaatgctatatggtgggtactatgattaatctcattttacaaatgaggaacttaaggtttagtcaaggagaacaccttccccaaagtctcacagctagtaagtaccaaagcaaggacttgggcccagacctgtctgactgcagagctcatgctcttagcagtgtgttttactgtttttgcttatggcttccctatgtcttgctttactacctttagataccatatttagtgatggttttgaagtagctgggatctccatgtgctattacatctgcccagttttagagcagtgtctcttacccataatttagtcagattgcaacattgatccaaatgtgtttacacttgagatcataatacataaggaaactcaaagttttgaactctaacacattcccactttttcttgcatattatagtgtcaataaatactgaaaaggaagaactgtgctttcttcctcagaaagaggaagatttatgaccaggtggtgataaaggtgaagtatgttctgatggacatacttccatacttctaatgggcatatgtttgtccattccataagattttactttcttagttataatacatagtatcttcaggtctggctttgaaaagaaaatagggagtaacaataatttgaggaatataatgtctctgtatgttgcattttatattattttgaagctttgagacacttgttcatagtaagggcagctttgttagcaaattgtttccaatgagcttgctaaaaacaaactttttgatactgttttgtcacagatctagtcctagaatgattatagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttattcaacaaacaattgaaaataatattttaaaggacataatctcttcatatcacatcttaacaattcttgaatgagatccagtttgtccatgccttgtaagtaagtttataacctactatgctttagggcctcctgctaccttaggttgacatatatttaagaaaaataatttcatttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtggctaaaatcttgtaagcagtaattttgtgtttatgatggctgtctccaagtttgggggaaaataatggcaaaacaaaaaatcacatttgagtagttcttagagcaattcctagagatgtatttcttacctggcctttcctctctaccctgtatctttgcattatttaatacttggaaaaacccacatagcattaaaaacaaagtactactgaacaaagtgataaatacattttcttaaatctttcttttctaaccacaggaacatttaaacttacaatagaattcactgaagaatatccaaataaaccacctacagttagatttgtctctaagatgttccatccaaatggcaagtatcacttttagtacagtgttttaaactactatagtgtttattatggagtattccacatttcctgtgtattttgtggtgcctgagtatttgtttaggcagcttgctgcttcttgaaagctgaacttgttcttggttgtctgtggctgtcttgtcctagaactgaagcagtggaggtattttccctttgcttggagtctgggagcctcctgattttgatgacctttgtcatttacttattaaacaaaatgaaggatgctcttgaggtttccttttaatgctaggccagattgggatagtcttgtgttgtaattattttcactagcgtttagaaaagtagttttcattggacgcatatcagaattactgtggaacattttaaaaacacagatgccttcgccccactccaaacctaatgaataggattctgttgttgaaggccaggcatacggtattgtcagaaaagcaccacaggtgattctaacttaaccactttgcactttttaaaatagtagtaagcctagaacagcttgccttttatttaggttaatgaagtatttttcagggtatcagatatgtttatctttatgccaaaatgaaatcttgtgaactctgagtgatcttttgttatttcagataggggatacagcctacaaatttggtggaatgaatttcccacatgtctgtggatagctagggaccctgttcaaaaatgtttctgatttcctggataatagggcagccttttccaaaggatgaacactaaatatcttccagttttatactgatcacatctgacattctctgatcatcctgattatttcactagtggtggttatgacttatctttttaggcagttaactgggaagcaacataggaatctttaaacttcaaaagcaaagtattcttgactatttttgttttgtctataatgttaaaaccttagtggtcttgttacgtttaatgtacctacttctttgttcttagtctatgcagatggtagtatatgtctggacatacttcagaaccgttggagtccaacctatgatgtgtcttccattctaacatccatacaggtgaatttttccttaatgtgacgaactataacttttaatatgtttatattagcaattgaattgtttttgaaagtcataatgtaatagatctttttatttttggtcaaagcttgtttgttttatagatgaaaagtagaccattaagacccaagtcagctgggtacagtcgctcacacctgtaacctcagcactttggcaggccaaggtgggaggattgcttgagttcaggagtttgagaccagcctgggcaacatagtgagactcttctcccttaaaaaaaaaaaaagccgcatatattttcctagctactagcagattcacataactctgggtttgtatgctaaagacaagaaatgtagctgtacttaggacaattcaattgagtgtcactaccttataaaatagttgttttgcattaaggaactgacattttaaaaattgtctctttagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaatttcatagtcaaggtatctttttttttttttttttagctcagtataaactttttgtattggtttcttattgggatctcatatgtactcatttcccccctcaaacattaaggtaaaagcaaaaatactcattctgggaggggaaaagacaagacagatacttctggagagaactttttttttctttccagtcataagt[132 bp omitted]tgaaaccctgtctctgctaaaaatacaaaaagaaattagccaggcgtggtggcatgcccctgtagtcccagctgcttgggaggctgaggtaggagaatcgcttgaaccaaggaggcggaggttgcagtgagccaagatcgcgctactgcactccagcctggtgacagagtgagacttcttcctctcaaaaaaaaaaaaaaaatttaacagaatgtaaaattattaaataaagttacctcagtatacattataatcaatcaagggaatgaggttatggggggcgtgcggggggcagggataaaccaacctaggtatttatcagcaccctcagagaccaagatctaacttgttgatcctgacataccacctctttaaaagccctagctcaaaaacaaacagtaccaaactttttttttttttttttttttttttttgagacggagtctagctctgtcgcccagactggagtgcagtggtgcaattttggctcactgccacctctgcctcctgggttcaaacgattctcctgcctcagcctcctgggtagctgggattacaggcgctcgccaccatgcccagctaatttttgtatttttagtagagatggggtttcactgtgttggctaggctggtcttaaactcctcctgacctcatgatccacctgcctcggcctcccaaagtgctgggattacaagcctgagccaccgtgcccggcctagatggtattttaaatcctatgcaaagtttgggagtacagatatcctcaatcactttgattaaacaaaactactttcttctgaggagcaacccatctcatttgaaagaggcaaggacaatgactttgtaaaaactaccacctcttggtacttgtttggttgggtggatggggctaaatgaagttaagtccttatgacacatgtatctcactcatcttttaagacatggtacttgaagcctcagtatggagtacaatctgtactaattaccacattacttggattgtttcacctaggagcaatgtccttcaatttgcttaatagtttccctcaagtccatttctgcttcaaagtagaaccacattaaatttttctatttggtggattagttttacattaactttttcatcctgctatgtggctgagtgctttaaattgacactgttaatcatacctgaaacaatgtaaggcgagactcagaatggtcaggtttaataacttttttcttctgtacacctgagaaacactatacccaatctctttcacaggataatccatttaaaaccttacaacagagccaacaagctgacctcccaaaacaacatatgcatggtcaaaggcaccacaaaccattcatttgaacatttcatgctaattgcctctttctccctttaaaatttttaacaccacaggctacatgtattgataacaaagttaatgaaaacaaatttgcaatgtccctttttcaaatggcagtcaggtttgaacttttcaattctgcacgtgctgatgtggggaaggaggtatgatgaagaaccaaagctgcaattagaatcctttatttaggacccatctccagcttcaggggttactcatagcaaagagaatgcattgtatactactaaaaaagaatcccaacaaagtgcatgatattgccattcattttgcaatcaaaggggaggaaaaaaatccaaaaagtagatctgtgatactaaaagctagatataaaatggaaagaacagttagttcctcagtataaaaaacacttaatccaaataaaatttgaaattgctcatgtacctgtacagattgtataggaaggttactgggttaagaatgactacatttcaaagaaagggaaaatacagtaaccaactgaaaggggacaaaatggaacaaaatggaacaacagcaagcttgtcagcagctcattcatgccaacgccattctcaacattattttatcctcaagcaagttaagtgattttgctctaattctgtatcaatatcacagatcctaagaagttaggcaatctggcccctcaaatccagtaaccaaatttgtatctacttggtgcaattatttgggagccttcctaactgtaactaccttaatattctgttctgttggactcacctagacaaaccagattatatttaacaatcccctacctttccctgcctcaaaatcatttgggggaagaaagaaatgtaaagagagtaatcagtgaagttttcatatcccttaatcccaaagccactcttactcagagaattgaaaacaggtttttttctaactcacaaattcaaccatagcttctgaaggttggcatgaaccttgtaaattaaaaacaaaacaaaattgtagcccgggtgtagtggctcatgcctgtaatcccagcactttgggaggctgagaagggtggactgcgtaactccaggagcttgagaccagaatcccatctctactaaaaatacaaaaaattagccaggccaggcggtgcgcacctgaagtcccagctactcggaaggtggaggttgcagtgagccaagactgcgccactgcactccagactgggtaaccggagtgggaccctgtctcaaaaaacaaattgtaatcctacaaaatctataaacattttgcttagttttttttgccaatgttaatatgaagtggcaaaataaaatgtacacctcatttctcttcctaccgacattaagaaaggctatgcactgtaggaagacggttaatggaaaacaattatcacactgtttagttaccgtagatgagtaccagttacagaaatccaggtgtaaaggctaatccctttatattttttaagcattaatttaactacagtgggcagctgcttaatgtaaaatataaaaaacagggccaggcacggtggctcaagcctgtaatcccagcactttgggaggccaaggtagggagatcacctgaggtcagaacttcaagaccagcctggccaacatggtgaaatcccgtctctactaaaatacaaaaatcagccgggcgtggtggcgggtgcctgtaatcccagctacttgggaggatgacacaggagaatcgtttgaacccaggaggtgaaggttgcagtgagtcgagactgcaccattgcactccagcctgggcaagaagagcgaaactgcatctcaaaaacaaacaaacaaaaaacgggaaaggaaattacgatttcttgttggccaattacatgtcaagcacggtgctaaatgttgtcaagcactgtaaaccacctaattgtcctgaacatcatttcattagaggtgtctagtgagcaatggtaaattcacctgtgctgttatgaggttatacttgatttatctgagatacaaaaataaaatcacataaaagggggcagccaaagatttggttgaagccagcatgttggtccataggaaaaaagtgatagttgactgattcctatctgttaaatccggacattcatccacatgtgctctgggtgctgaactattctgtgcaaacaccacttcccttctccaaagacccagtgttgctacaaggctgctgcccggaaatgagcacgccaccattctgatcaactttggctcctttttattcaggaagcatacactaattctttttatacattttttttttttacattccagaaataagcgaaaatagcagttttaaatatgttacaaagttggcttttcaggcttaataagctttttgagagagggaccagccaactgaccttttcatcaaagcaccaatgtatcttcagtcttttaccaagctctaccacagctgtggttgccttggatgtgctgcacatccaaaccgtgtgaaagctataatggagagttgctgtgagtctctctgcaaggcaccaagaacaaacagttcaagcttcctttcttcagattgaaccaaagtttttgaaactttcaactgctctctcaagtagtgctctctcagcgtgaagactagaatttgttaaaacccatatatcacaagatacagtaaatcacttccaatagtctggaaatcacatggtagaagttataaataaatgaacactaaaattactttaagaaagttttacatcatttagttggtaaggacatttacgtgtacagcacaatttattgtcaaacattctataactggcttcacacaaagatgaaaatagattaatacaaaatgatctgacattttcagtaaatctggaattaagactggatttttattgtagtcaatatcaactttacatattgttgcagattgctgtgctatgccctttaaaatgataatttctcagggtaaaattccatttggatatgtgttcttgcttgtcaaactactaaaatctgagggacacagcaatatcaaagacacaaacagtaactgcacaatatcatctgctggattaagctaatacaagtggacagaattctttaggttccaatatctaataaaccactatgtgaaatgaacaaggtgagacatcttatgaatatactctgcaaccggaacatgtagcatttctttaattcaaaaatctgcctcattaggcatttacaaaataaattagtaagatctcaatttgcttgaggcataacaagctcgtaatggcccacttggccttcctgtttgagctgatctagtaggtcttccttccgtctttttctacctaccactaggtacctatcatggcccaccccatgagacttactcttaagaccatacttctgggcaatctgatgtatttgcttccgttcatcattagtcagctctctagagaaagtcaaatctgtgtggctctcggagcgggcgtagtttctgatgatctgttcaatatctctcttggcaattttattcaccctctctacatccagaccaagcccttcccgcttatgctgctctttcactgagataggctcccgtatgccctcaccagatttacctaaaccaccaccagtccaacccatctttctcagcagctgatttccaatattatcttctttgatttgctgtttgtaagcctcctctgctgagcggccctgaatttcatttcttgaaatcacatcttcaacagctcctttcttcaagttgttaatgacagttggctgggtctttttgagggttttcacagcttccccagcagcttcatatttgacagttttcttcaccccaactgcttctgcaattacttcactctctagaatcactttgcatttccagcggaggcctgtcatcctttcatagacatactcaactgtcattcggttaaactgagctgtgtcgttcagcgtgcacacgggatttgaagaattctcataaactacaagatcctttatatctttcttctttccagatcctctgggtgaagagcctgtatggcattgtgaacttttgacagatggataagtgggctgtgttttttgaagaattttcaaagcctcgtcggcagctgcatgtttacttgttttcttggttccataaccttcagctaagcagtgatcttgtaaaaacactcgacaacgccatgtgcgatttggcatcatctcatatttgtattcaattgacatcttgttgaatgaggcagaattgttaaggataccaattgcatcatttgcattttctgtaatgacaaaattggtccagtgtttggcagaagcattaaaaattggctgcccggaagcatctttacccagcaccaccaggtcttctggtggcttcagagctggaggaaattcataggaggacatgccaatctgacacaccacgaggtcctctccaaatgtatgcttgaatttccgccggacaactctaacttcaatacgtttctgcaagagttttacagctagctctgtagctcgatccctggacccattcttgctgccagcataacctgtagttaagtagatattttggcatctaacttcacaagcatagccatcagttagaagttttttatttttggggatgtcggcaggaggaatttcctttaaaggagcatatatatactcaggatttgtcttacacgcctgaatacaacgagttaacatatatgtataattaattttatcagatccagaagtcatttctggattagaaaggttcttccagattgtcgccgttaatttttcaataaaatactgcttctcggctaccacagactcgggaaatgtctgtgatggtgaaggctcaggagttgactgagagtttgcctgctgtgatgtggtgcttggggcagggttcccactgtcaaaatacatgttggctgttacaggctggtcttttgtgagaatgaatcctgatgaatcacaatactgagaattcccatcttgtatactgaaagagtcttgagtataatcttggtagatgtctcttggcatgctggcaaaatgtgtttgttcatttacctcttttgtttgagggccataaggatcttcctgtctttcatcttttgaactactagctacaaaatgtacaggctcaaaacgaggtctcgcatggaatttggaaccggcttgctttttaggaggattttgacctatagaatgagtgaaatttacaattcattaaaatgggaatatttcaaaagaaccaagcaggaaaatagtaccaaccatattatttgcaagctgcattgttggtacgagatacttccatcacaaaaacttcacgccatttgggtgaagagactcaattatcaatgtaagattccagcataaggagggatgctccctgtctttccacatgtaagggaagacccttgatagaaaatataccattaagtcaagtatacaggtcaccaccacacatgactggtagctgcttttgcatcaaatgagctaaagcacaggtgaagtatactcttcacttgtgctggaaggtgaagtggactggaagattgttccagtacaatctcataccacccatgctgaaaagctcacttaaggattgaaaatggaacagatggctctaatgcaagacagataatgagcagaggcagttacaaagcctttctcttttgtatcagaggtgagtgactctgtgatggtgctttacatagttgtgactaaaaatcaaagaaaaagaattatcaaaagattcagaaagttttcaacttcaaaacctcagctctgacccattcatcacaaaagggtgtttgctctattttctttctagaacaaacaacagctggaaactaatgatttatgtgagatgccaaatttaaagctatggaagaactctgatgaagctatactagacactagagcttcctccctgtaacactgctcagtagaaagctcgtccatcctggacccatccaagaggatttagtgacttagatgctcaagtgatcacagtataagattttatttagagggcggttccatgacataaatttcaaggactgcataataacatgatttcaatattcttagttttcaattctatttagcatcctcaaaaaattgtatataattaaaagctaaaactcttttacccgtaagaactaatgttaccaatgttatttgaaatcttataccacactcatatcatttttttaaagccatgttgtttcttcaaatcccacctttcagaaacaagtatactcaccatcacatgttgagaggtggcgtttttgacctttggaaggtttggacagcaccagatcatatgaaggcatctccccaatatcaataccttcagccatttggagaattttttccatcaagcgtgggctgtacctatttaagttaatataatctacagttaaaacaggtaaggatgtcttttttaaaaagcttcaaaataagccagtcttataattgctcccacaagactttatcaacagggtatcttggctataaaaccaaagaatcggccctaaaatatttacccatcaaatgaataattatgttactaattaggaaacaagatttttcagcataagacatacaaatataaactcaaaaaaatttagcaaaaacctcatctttaatttgaattgaaaatatcagtataaattcatgacttgttttgattgtggtctctatcatttctcatgaaatggaatcagggtccttagagaaatggctgattctaagtctgtggcaggaaatgtctaaggtgagcctgagaaatcatctagcacctaaaaccaaggaaactgtcaaagatcaaaggtgttgtgtcaaatggactcagaagccaatttgaatagactcttactggcaaagtgagccaactcaaatatcgataagaacaatgatggcaatggattgaaatatatcaaatatgttgaaaattcattagttcataatgatacttacaaactattattggtcacctttggaggatggaaggaaccatgtcattattctgcaaacaggtaaatatgaaaggaagaaagcaaacatttatcctgtattctcctgtataaattgtacttagagcaaccaaagagatgatgaggaaaatgtcttttagagaagcattccagctaataaatgaaggaatggactactaccattttgtaacctataataaaaaatgatcatcaggcgggcatggtggctcacacctgtaatctcagcactttggaaggcctaagcgggtggatcacttgaggtcaggagttcgagaacagcctggccaacatggtgaaactccatctctactaaaaatacaaaaattacccgggcatggtggtggacacctgtaataccagctactcaggaggcggaggc[131 bp omitted]aatggctgctaaacctattaggtgaaaagctaatgggggaagaactcacagtcagacccaagcaaatattctcaactgattattgacaaaggtgccaaggcaattcaatggaggaaggatagccttctcaacaaatggcgccggaactagtaggcatccataggcaaaaacaaaaacaaaaacaaaaaaaaaacaactctacacctaaacttcacaccttatacaaaactaactcaaaatacatcataaacctaaatgtaaaattatgaaacttttactgaaaaaaaaaacacaggagaaaatctgtgggatctagggttaggcaaacagttcttaggcttgataccaagcatgatccataaagaaactggtgataaaatggacgtcattgaaattaaaaagttttggctgggtgtggtggctcactcctgtaatcccagcactttgggaagccgaggtgggcggatcacttgaggtcaggaattcaagaccagtctggccaacatggcaaacccccatctctacaaaaatagaaaaaaaaaaattgctggacatggtggtacacacctgtagtccaagctacttgtaagactgaggcaggagaatcactcaaacccgggaggtggaggttgcagtgagccgagattgtgccactacactccagtctaggtctgggtgacagagcgagactccgtctcaaaaaaaaaaaaagagtaaaaagttttgctcttgaaagactgtgaagaggatgaaaggtcaagctgcagactgggagaaaatatctgtaaaccacacgcttgacagaagactagtagtacctaaaactcaatagaaaaaaaaatcaaattaaaaaatgaacaaaagacataaacgaaatacttcaccaaagaggatagacagattgcaaataagcacatgaaaagatgttcatcactagccaccagggaaatgcaatttaaaatcacaatgaggtatcactatacacttattagaatggccaaaataagtgacaatggctgggcacagtagctcacgcctgtaatccccgcactttgggaggccgaggggggtagatcacgaggtcaggagttcgagatcagcctgaccaacatggtgaaaccctgtctctactaaaaatacaaagattagcctggcatggtggcatgcgcctgtaatcccagcttctcaggaggctgaggcaggagaatcgcttgaacctgggaggcagaggttgcagtgagccgagattgtgccactgcacttcagcctgagtgacagagcaagactccatctcaaaaaaaaaaaaaaaaaaaaaaaaaaaaaagtgacaataccaaatgctggcaaaaatgaggagaaactggatcactcagacattgctgctgggaatgtaaaatgatacagtcactctggaaaacagtttggtagtttcttataaaaccaaacatcaggccgggtgcggtggctcacgcttgtaataccagcactttgggaggccaaggtgggcggatcacctgaggtcgggagttcgagaccagcctgaccaacatggagaaacctcgtctctactaaaaagacaaaattagccgggcgtggtggtgcatgcctgtaatcccagctactctggaggctgaggcaggagaatcgcttgaacccaggaggtggacgttgcagtgagccaagatcgcacgattgcactccagcctgggcaacaagaatgaaacactgcctccaaaaaaaaaaaaaaaaaatcagttaccacttgatccagcgattgcaattatactcttggacatttattccagagaaatgagaacttatgttcacacaaaaacctgtacacgaatgttcatagcagctttatttgtaacagcccaaaactacaatcagcccagatgtccttcaacaggtgaatagttagattctggtacacacacactatggaacactacttgggacaaaaaggaactttttttttttttttaaacagtctcactctgtcacccatgctggaatgcaatggcgcgatctcggctcaccgcaacctccgcctcctggattcaagtgattctcctgcctcagtctcccaagtagctgggactataagcatgcaccaccatgcggggctaatttttgtatttttagtaagacaaggtcatcatgttgaccaggctggtgtcaaattcctgacctctccgcaggcctcagccttccaaagtgctgggattacaggcatgagccaccgcacccggccatctctttgtattatttcttacagttgcatgtcaatctataattatctcaagaaaaatttcagtttaaaaagctgatcggggactttatcatcttaatatcactaaaagtgggacaaccgaacatgtaccccacgatgtgatacaataggatatcacggcactatctagaaagcgttatggctctccagagaattgaacctgaaactaatcaagttcctgactcccagaaacatgtgaaacaccacaagaatggaactatccaactccagaatgagggaacagtatgtgacagcccagtttcctcatcaaataaatactgtagaatgaaaataaaaggaagagggagtggttataggttaaaggagatggatcaatcaaatacattgtatagactttgtatcatgaatgaatcaaacgagctgtaaaaagacatttgagacaaatgaagaaaactgaacatgcaataggcattgggtgatttttaagaaatcactgtaaattttgttgaatatgaataatggtatggtgactatttttaaaaattcttatctgatacagatgtgtactgaagaatgtacaggtgaaatgatgtcaggattttataaaatatactccagactattgcccacaaaaacctagggcagaatagatgaagaagggtagcatggcagactgctgatgattgctgagtgatgggtacatgggattcattaaactcttttctacttttgtgtgcttgaaattttaaggcaaagctttaaaatatacaatttaaaaaatggctcctggctgagcacagtggttcatgcctgtaatcccagcacattgagaggtggaggtgggcagatcacttgaagccaggaattcaagaccagcctgggcaacatggcgaaacaccatcattacaaaaaataaaaataacaaacaaacagaaaacgtagccaggcatggtgacccatgcctgtagtcccagctacttgggaggctgaggtgggaggatcacttgagctgggaaggtcaaggctgcagtgagctgtgatcacaccactgcactccagcctgggtgacagagtgagaccctgtctcttttttttttttttttttttttttgagagggagtcttgctctgtctcccaggctggagtgcagtggcacaatatcagctcactgcaacctccacctcccgggttcaagcacttctcctgcctcagcctcccaagtagctgggattacaggcatgcgccaccacgcctggctaatttttgtattttttagtagagacagggttttgccatgttggccaggctgaccttgaactcctgacctcaggtaatccacctgcctcagcctcccaaagtgctaggattacaggtgtgagcaactgcacccggctgagacggtctcttaaaaaaaaaaaaaaaaaaggctccttatgaagattggctgcttgatagaataacattttactacagagaaacagaaacaggagctcaagtgaagtgttggttatgacggttacctgctctcccttcctaccttcagagccttccccagcctaggaccaaaaaagagattcctggtagcatttgggaagaagttctgaaaatgagtaactatcatacctttacatgaatcagttctgaaccagaaggagggtaacattttccattttcagtagaacaggttgcacacccatcacgtatcattccacgcaaagcagaagtcaaggcacggtggcctccccgacagactgctggaagctagctctgttgtaacctgtacttcccactgacaactgttgctgctaaagctagcacgagtatttaaataccaagagtaattttattttcattgactcttatctgaacatcagaaagcacagtctaaaacacaatatggctgggcggggtggctcacacctgtaatcccaacattttgggaggctgaggtgggcagatcacctgaggtcaggagttcaagaccagcttacccaacatggtaaaaccccgtctctactaaaaatacaaaaattagctgggtgtggtagcaggcgcctgtaatcccagctactcaggaggctgaggcaggagaattgcttgaacccgggaggcggaggttgcagtgagctgagattgcaccactgcactccagcctggacgacaagagcgagactctgtctcaaaaataataataaaataaaataaaataaacacaatacattctacatatcacttccattcaaatttgggagtacatatttccaaagtatgagataaaaacaaaagccgggcgcgtgtggctcacgcctgtaatcccaacactttgggaggccaaggcaggcagatcacctgaggtcgggaattcgagaccagcctgaccaacatagagaaacctgtctctactaaaaatacaaaaattagccgggtgtgatggcgcatgcctgtaatcccagctacttgggaggctgagacaggagaatcgcttgaacctgggaggcagaggttttagtgagccgagatcgcaccattgccttccagcctgggcaacaagagtgaaactccatctcaaaaaaaaaaaaaaaaaaaaaaaaagtctatgaaaatgagatgagtctataaatcttaaactactaatcccacgcctgttaccaaaagtggccctacaaccaggcaacttaccttgaattccagtcaatattctccagaccttcagttagagcccgattccaagtacagtatacaactgcaaatggcatatatgtcttacggtgtgatgcacttagggctcactcattcatgctcacttttctcaggtttcttccagcattagtaattattctacctacttactataccctattcattacatctgccacaaaattcaacttcacccataggccataaaaataagtctttacataggttgctgatacagttctctgtcctttgctatgaagtcataatactgaagaagcccagccagtatgaacaataatgaaaaagaccgtatagtacctaacaaacacttcactattcaaagaacaatgtaaatacgaatctagagtgtttagtaagaccacgaggcttctacaatccagagtagctttccaaagataaagaagtggtgccacatatttaaagtaagccaaggcagtaaagcttttattattcactttctccagagtctattttttaatagtgtgttttaaagtaacacctttaacaccaggcattttagaaaatccaccaagaaaagcacctacattcccaaccactggccgggagcagtggctcacacctgtaatcctaacactctgggagaccaaggcaagaggatcacttaagcccaggaattcaagatcagcctgggcaacatggcaagaccctgtctctacaaagaaaaaaaaaaaaaaaaagctgggcatggtggcatacacctgtaatcccagctactcaaatcacttgagcctaggaagttgaggctacagtgagctgtgatcacaccactgcactccagcctgggtgacagaggaacctgtctcaaaaatagttataataaccccaaccactgataacttcatcaacatgttgggttttaattaatttttttttttgagactgagtctcactctattgcccaggctggagtgcaatggcatgatctcggctcactgcagcctctgcctcctcagttcaagtgattctcctgtctcagcctcccaagtagctgggattacaggagtgcaccatcatgtccggctaatttttgtatttttagtagagacagggtttcaccatgttggccatgttggtcttgaactcctgacctcgtgatctgcctgcctcagccccccaaagtgctggaattacaggcgtgagccaccgtgtctggccatgtaggggtttattttttaatgctttttctgtgttttccataactccccatcactatcaagtcatctatgttgatttcaaatctggtggggttttttgtttttaatttactgtatcataagccttttctccacatcattaccacatgagttttaatggctatacagtatttatattattgaataaaatgtaagatatcattaaggcaagtctaatatagtaattttttaagatgcacgcatactatatttttaagtctgctaagttaccctttagattataaatgcttaaaaaagaaaaccaggccaggcgtggtggctcatgcctgtaatcccagcaattgggaggccgaggcaggcggatcacttgaggctaggagttcaagaccagcctggacaacatggtgaaaccctgtctctattaaaaatacaaaaattagccagtcatggtggcatgcacctgtagacccagctactcgggagactgaggcaggagaatcgcttgaacccgggaggcagaggttgcagtgagcggagatcacaggctgcactccagccttggcgacagagcaagactgtctcaaaagagaaagaaaaaaaaagaaccccaaaattctgaggtcttatggttctcaaaagtagctgatattataccaagcttttggaaaccaggatgtgactcaactatcccaccatatctagcacataaaaagatgatttctaatgaacaaaaacatctgtcttcataagttttacatctctggacacaagacaggtgcatatatatgcatacttatgaataacgtaaaccactataacatacaatggcagctgaaatttaataaatattcagtaatagatgcttacaaaactttttttttttttgagatggactctcactctggcacccaagctgaagcgcaatgacgcgatctcggctcaccgcaacccctgcttcccaggttcaagcaattctcccgcctcagcctcccgagtagctgggactacaagcacccatcaccacgcctgagttttaccacgttggccaggctggtctcaaactcctgacctcacgtgatctgcccgcctcgggctcccaaagtgctgggattacaggcatgggccaccggccacggccgttttacaaaactttaaaaaagtatattaaactgttctactaagttcaaataaaaaagctgagatttgaaaattaagcaaagattaaggtttccaagtgtaaaattgtttattcaaaactattcataaggaaaactaattaaaaaaaaaaaaaacttttcataagacgggccggagcctggcaaaatggctgatgcctgtaatcccagcacttcgggaggcccaggtggacggctcacctgaggtcaggaccagcatggccaacgtggtgaaaccccgtctctactgaaaatacaaacaaaattagctgggcgtggtggtgcacgcctgtaatcccagctactcggaaggtggaggcaggagaatcacttgcactcaggaggtggaggctgcactgagctgagatcgcaccattgcacttcagcctgggtgacagagcaaggttctctcaaaaaaaaaaaaaagaagaagaagaagaagaagaaaaagctgggagcagtggctcatgcctgtaatctcagcactttgggaggccgaggcgggcggatcatctgaggtcaggagttcgagaccagcctgaccaacatggagaaaccctgcctccactaaaaatacaaaattagtcgggcatggtggttgcacacctgtaatcccagctactagggaggttgaggcaggagaatcgcttgaacccgggaggcggaggttgcggtgagccaagatcgcgccattgcactccagcctgggaaacaagagcgaaacattgtcacacaaaaaaaaaaaaagaaaaaagaaaaagaaaaaaggactcgggccaggcgcggtggctcacccttgtaatcccagcactttgggaggccaaggcgagtggatcacttgagctcaggagttcaagatcagcctgagccacagagggaaaccccatctctattaaaacaacaacaacaacaattgataagactcctgatataagttaataacatacacccagattattgataatctttcaaaagctctcacacccatttcattagctagtgatttatgcactctccctactatgtgcacagttttgcaacatgagcccagccaacatctatctaccttccaaacaccagtcttgtatcaaccaggaaaagacaaataagggagcaaagctggtttcattttaaggtatattttatctattaattaatgtctcatcaaaggtaaatagtaggccagaattctccttctaatcttattgatcaacaatgactggaaaactaaatgccccagttaatcaaactgctttattaaatataaagacactatctacaattttaagtaaaaatcacacagttctctaggcattcatatgtacaattatttaagtgctgtagatgtagttggtcagaaaactgaactaatttttcactagccacaagacatatctcagaaattgcctgcagaaaaaaattcttggttaagttgtttacttggacgaaacagacaaatgaaaaaatgaagtgaaacaattttagccatttgagctttctggttgcctggacaattagggagaaaatgattaaaaaacagaatagaaacatttttattttatcctacaaagcagtggttctgagagtgctgatctctggatcagcaacatcagcatcacctgggaacttatcaaaaatacaaaatctgaggccccacctcagacctaccgagtcagacaccctggggctgggacccagcaatctgttttaacaagcctaacaggtgattttgacgtgtacttaagtttgaactccccagttacagagtcaagaagatattcaaatttgttctgtggaaattgccaccatcaccaaaaggaatgaaataaggtctgtttccctgcacatttgagttcctcctggcttggtcttatgatgaaggaattttcaaagatttctttgacctagaagtttatttcagctccaagtaaaatggaatacaaaacattttgccagagggaaaaaagagcaaggaaattcctttgtgctattcttcacagcctgttccaaaagtcaagtgataaacctcgagcaacaaatcaacaatttaaggccaggtgcagtgactcactcctgtaatcctagcactttgggaagctgaggctggcggatcacttgagccccggggtacgagaccagcctggccaaaatggcgaaaccccgtctctaccaaaaatacaaaaatgagccgggtgtggtggtgcatgcctgcaatcccagctactcgggaggctgagacatgagaattgcttgaacccaggaggtggagg[131 bp omitted]acttgagagaagagtattctgccacagaaaacaagaactctgccaaaatctacattaacatcaacaagtattggaacacaagttttacccacctgaagatgagaggtaacataaagcccatctaaagactgcacttggtccctagcttccaagagtcttcattggcccttccctttcttctatatggaagctatcagatataatgcaaacattacttttcagttaagctatttgataatgtaatggcaattcttgtattaactaaactgacttagctacaatgtaacatggtgtacatacatagtatgtacaatgtagcatacatagtatccacagatgcacctgtgtgcacacacaacagcctgcaattcttgagcctttaacaccaactaccattggcctactttgtgtttttaatgccctggttatgtacaagggtgttgttcttggaattaaatcctgagatataatgatgtggcttatgttcagttacttgctttcactcatgatccatccttcccaaatatggcagctgtggctcagtggaaagagcatcagtctgggtatcagaagacctaggtcctagccccagctgtaagaccttggaaacgtcacttaacttcttggcctccactgatttagcagtaaaaatgagatgccacctaatccccaaagttgttgtaggaaatgaaataataaatatttaaaatgtgttgtacatcataaagctgtatacatccactcactccacacacatttattgagcagctattatttagcaggcaatcttctaggcactgaggataaaggtgtaaacaagaaagcaaaatccctatccttaagggagcttccattctagtgggaaggtaagatttattattaacacaaaggatagttatcctcatttaagtttttgtttttattttaaggattcagatttccgacagccttctgtgatattatggagacttacgattataggataaaggtaacttttgaactcaagaacaacactgttaggcaaaggtcaagtagatttatctgacttgttcaataactaaggcttcttcagttgtaaccagttcctcctaatcattatctctggaggtagaaattatgctaaccttgagaagacagaaaagtaatgtctgtgatgagagcaaagtatatcacactgaatgccatgttcaataattaagggcaggaggagacaatcctatttttctgcatctgttacagtcactcctggaactgaactggccaaaattgacatgatcatattccagaatctctcacccttcctgatttaaaaaaaaacaaaaacaaaaacaaaaacaaaaaactatgattgcaggaatgtcaaaagaagtcgtctcccaatctatcaaagaatgaatagtctagtatagggccgatttaggggttctgaaggacagaggtccaagtagcctcttcaaaaaaaaaaaacaaacaaaacacgctgcgttggaaccatactgcagtctccattgaatgcaaagagctttcaaagaggcctgttcaaaacgtcaccaggttctaggaaaggggggaaaaacaaacacacacacacccccacccccaccacagacacacacacctaaaacctcactcagagccaaatgttaatccttctgatcccatttagggtaaaaagagggcaatccatttttacagtagatatatccatttctttgtttgagtccagacacattatgcgcaaatctacaagcaaggctgacgctgctgcggctcagagagctgatacgtaccgcctccccaggagaagacagtaagaccctgctagggggctgcaagtagaggggggtatttaagaggaatggaaaaagagagtggtcaggaggagactagaacagtggggtcccctcgcccttcccccacaactccaactgtcgaatatattctctgcggatactgcatccttggaaggccctacgcaggtccgagatgctgctattcatcattccccacgtcctctaataccgccaccaactacaatgaccacctctcaataatcctcttctaggcgctgcttcatctccatccctggtcctggagaggccgcttccgcgatctctgcaccctcctagctgttatgtcatgcccagccaccacagtcggccaccccacccccaggccaatagtgatccctctagtgccctccagcacctccaaatctccagcctccaacctatcctccgcatcccgcccccgtccctatcccaaccaccatcatcgatccctccagcgccgtccctaacccgatcccccatcaccgatctctcacccccgtccctaacccgacacccacaccttcctcacctgcagcccaggaagacgtggttggtccaggcggcggagagcgcgaggagctggtcgagggcagccccgggatagctgtgcaggtgccgacagatgaagctgcgccgcagagcccactgccagtcactttcgtggctatagcgccactgctccagcactggctcgggcgggggcggcgggaggggcggcagcggcggcggcgggagggggggcagcggcggcgcgacaggaagtcgccccccaacagcagacgtcctccagccatcttctccgcccccaagcagggaccccagggacgaagccgactacggaccgcgagctaggcagctagcaagcgggcggaaacggggggccggtgggaggggccgggtaaggaggggcgcgctgaggggagaagatcaactctcggggggactggagtgtgtgcgtgggggccaccgttaggaggaaaagaggagcacgagctcgcgtcccgacactgggatgcacgtcccctacactcctctaactcgtggaggagcagaagggcttccgccgcactcacgcgcgagccggggaggccgagtcaggctccgcacctccacggatccgcagacccacgcactgcgcggagagcgataaaagaccccagcacgctctgctcccctcctctaggttctagcctacctacccgcgtgccgtccggggttgtgaggccagtgcgcttgcgccgcggctgttccctaacttccaaatcccgtcgcagaatctcgcgcgacgtacttttttccctccagtgacgactacgggcctttgacgcactacggtgacaagcggagggcggggactccagaaagggaatttaggaaggttctctgaggttcgagaatatggttagaaggtgccctcagatgaatgttggtagcccacggctcgtctgacgcttttccctggatttttaagcggcgcgacagtgagaccatgttccttgtaagggatttaggtctgcactggactttacattaaaacaaaacaaaacagtcagctccccgaggtgccttttcttcagagagtagcttgaaatgctctgtgcatcgtgcatcattagctttgtgtaatagcttactgcggaaacgtagtaaaaatgaaacacttgccaagaaaatcatccacagcgccgcttctcaagttagccagtttcaagtccatactgtatcccaattacgaacacagatactgtttacacagttctgatcacgattgcaagtctgtatttcacgtatcaacttaagtgcaaaagattacaagatacaaaaggggcccacagaagagggtactgcaaggtagagccgctcaatcactgtagccaaatgtatcactccacccggagtcagcttcactcaataacttcagtccctatctgccaacctgtgtcacgaaagcagttaatcaatgagtgtctgtcggcgggaatttacacagcacctactgtgtgctcaatacagcaagagtacaaaaaagaaggaaagaaagtgggttttctctgttgtcctggaattgactacaatcttggtggggagaaatagccctgcataaaactaaatgttccaccaggagccggaccattggatgaggtggctttaacacactaccatctttaactctttaatgacgtatttctaattatatgacactttatgttaggggtgtattagactgagaggagcagaagataacagcactttacacactttcataatttatttccacgtctgtctttctccgtggtgggcattcatgtttattggggtaacaatcgaaatgttt[148 bp omitted]gaaacccctgtctccactaaaaatacaaaaattagccgggcgtggtggcaggcgcctgtaatcccagctactccggaggctgaggcaggagaatcgcttgaacccgggaggcagaggttgcagtgagccaatatcgcgccactacactccagcctgggcaacagagtgagactctgtttcaaaaaaaaaagaaagaaagaaaacagagcagtgcaaaggcaaatgactgggggaacactagatgaggagtcaggtgacctaaattctcatctcatcattgccaacaactatctctacagccttcggcaagacacttcacctctgtggccttatttttctcactcgtacaatcattacttgaatttattatctctaaccttccttcgtagtactatattctttgatttgatggtttagagactaacattacctcaataaacatgaatgcccaccatagagaaagacagacatggaaatacagaattctgaaactgaaaagtgctgttatcttctgctcttctcagtccaatacacccctacgcataaggtgtcatatagttagaaatatgtcattagagagttaaagagggcactgagtcaaagccacctcatccagtggtcctactgctggtggcacatttagttttacatagggctatttctccctacccagcttgtaatcaatttcaggacaacagagaaaaaccactttctttcctttttgtattcttgctgtattccactggaatgtcagttacatgaaagcatggaactcatctgttttggtcttagcacctataccttgatcctgcaggcactccagagatatttgttgaattaaatgcataaatgaatgaagctcttccttttgtctcaacccagtgaaaatcatttccttggagcctacattttaagctgatttgttattttataattagattaatttcagcctgctattgtttgagtgtgtccccttcaaaatttaagtgttgaaacttaatggctgatgtgatggtattaaaaggtgggacctttaagaggtcattaagccatgagagctcctccctcaggaatgggattaaggacctaatgaaagaggctttaatcggtgtttggtcacttgccctttgccttctgccatgtgcggatataacactcctctccccttgttgctggaggatgcagcaacaaggcaccatcttggaagcagagagcagagagctgccccaaccagacaactgaaccttctggtgccttaatcttggatttcccaggctctggaactctgagaaataaatatatattctttataagtctcaggtctcagtatcttgttatagcagcataaatggactaagacatagcctaagttgccaactttcaccaaaatccgcattgtaataaatatacatctttcctagaaaacaatctgtgaaaagataaactacttcctctcagcctggattaaaacttttccgttgtatagaaacaaataattgtaatctgacttttgaaattggattacaaaataaaaggtgttggaactgatgtaagaggccatctgctctggaacaaccataacaggattccatttgtaaatcccactaaggaataagcagtttcatccatagaacacaaatttccaggattctccatgtccttctctccctggtatccttctgattacaaaaaaatccatcagccaatctattttagcccattcctttctcacagccacagagggtttctcagtgagcaggagttaaaacccctgagaagaaatacattagttgaagagaggtgtaggcatagataataaag[136 bp omitted]accccatctctactaaaaatacaaaaatcagccgtgcatggtggcatacgcctgtagtctcagctactcaggaggctgaggcaggagaattgcttgaacctgggaggtggaggttgcagtgagctgagatcacgccactgcactccagcctgggcaacagagcaagactccgtctcaaaaaagaaaaaaaaaacaaaaataaaaacaatccggacaccacctgtaatcatccatcctcctcctctctattgcaggggtctgtcactgtcttttttttttttttttgagacggagtctcgctctaatccactgttgcccaggctggagtgcagtggcacgatctcagctcactgcaacctccgcctccctggttcaaccaattctctgcctc[134 bp omitted]gcctcccaaagtactgggattacaggcgtgaaccaccgtgcccggccgtgtcactgtcttaagacacataaacccccgttttgactgctttgagcttcctttcctgcttttgcctatagggggagtcagtacgtaatgaaaagacagaaacttggaacctgtcttttaactatcccataaactatcccaaaaatcagatcactaaaagttcttgacccgaaaattctgcaccaccatgtgctcttgaggaatgtttagtaacggattgaaagcataactaggagttctcactggccaattctgagtaatgtgagcaccaatattattaaagacagtaatgaattataaaccactgaaaacttgggagccataagtccacagtgataccaaatagataaataaatgagagagaagggagggcctttgcagggaggggctttgctttcagtcgaataccatgtgctgactggtaaatatggagggagtgctggagttggaaaatcatcattttatatagatcggtccaggcaaacattatcaacagatgctcaatccaaggagaaatttttgatgagtaagatatttccaggaacttaacagtttctctccacagattgtttattagtagcaataaaaaaaaaacagtaattatatcctggagaaattgggcaacaccttgacccaaaatgagaacatcctatttttaaaataggacttcaaaaatatcaatgtcatgaaagacaaagaagggctattccaaacgaaaggagagtaaaaagacagggcacaatgcataaacgtagactagatcctgtactgcgagaaaaaaaatgctataaaggatattatttgatagattagtgttagaatgtgaaatttacccaagttgataactgtctgcagttatgtaagaaaatattatctgtatatatggggcacatacatatatatggggcacaaaaatgataaagcaatagggcaaaatgttatcaactggtgaatttgggtcaagagtatgtgagtatacgttgtactattctttttttttttttttttgagacggagtttcactcttggtgtccaggctagagtgcaatggcgtgatctcagctcactgcaacctctgcctcctgggttcaagcgattcttctgcctcagcctcctgagtagctgagattataggcatgtgcctggctaattttgtattttcagtagagacagggtttctccatgttggtcaggctgatctcgaactcctgacctcaggtgatctgcctgcctcagcctcccaaagtgctgggattacaggcatgagccaccgcgcccagccgcattatactattcttgtaacttaatttcaaaatgtagtttgaaaagtgcaatagtgggccaggcgcagtggttcacgcttgtaatcccagcattttgagaggccaaggtgggcagatcacgaggtcaagagaccaagaccatcctggccaacaaggtgaaacccgtctctactaaaaatacaaaaattagccgggcgtgttggcgcttgcctgtagtcccggctacttgggaggctgagacagaagaatcacttgaacctgagaggcggaggctgcagtgagagatcgtgccactgcactccatcctgggcgacacaccgtgactccatctcaaaaaaaaaaaaagtgcaatagctcctgacattggtgaagaatataaatctagtgcagtggcacaatctctactcacttgcagcctccgcctcccgggttcaagcaattctcctacctcagcctcccaagtagccaggactacaggcatatgccaccacacctggctgattttttgtgtttttagtagagacaggttttcaccgtgttggccaggctggtcttgaacttgtgacctcaagtgatccgcccgcctcagcctcccaaagtgctgggattacaggtgtgagccaccacgcccagcctctagctacctcttaatcacttatcttgaggttgcactttactgggacctctggagagcttataaatgatgcccctactcttatgaagcttaacatctcttgaggagggaagtcccccaaataagaagcagagaagattatataagttcaagtaggggccggactcagtggctcacacctataatctcagcactttgggaggccgaggtgggcggatctcttgagctcaggagttggagaccagcctggcaatatggtgaagtctcgtctctacaaaaaaatacaaaatgtagctgagtgtggtggtgcgtgcctgtagtctcagctactcgggaggctgaggtgggaggatcgcttgagcccaggaggtagcagttgcagtgagccgtgatcatgccactgcattccagcctgggcgatggagtcagacagtgttaaaaaaaaaaaaaagttcaactagggagtttgaaaatggagaagagatcaggaatcaggataggtggatgagatcaagaaagtctttaaagtaggacctgagccttgaaggtaggatttaaatcagtagatgatatttcagacagagtcaacgaacagtttgtgtaactcagggagaggtttgtgcagagacagaatagactggacagagaacaaatattgggaagtgttgaaaaacgtggttgagtagatacaaggggccagtctgcaagttccccaagggcagcatcta[135 bp omitted]atccgtctctactaataatacaaaaattagccaggcgtggtggcgggccagggactacaggcccacgacaccaggctagttttggttacgtttcttaatggctgggaaaaaattgctgggcacagtggctcacgactgtaatcccagcactttgggaggccaaggtgggtggatcgctcgagctcaaaagttcaagaccagcctgggcaacatgaggaaacctgtgtctacaaaagatacaagaattagcggggcgtcggggcgctctcctgtagtcccagctacttgggaggctgaggcaagagaattgcttgggcccaggagctcgaggctgcagtgagctatgactatgccactgcactccagcctggacgaagagtgagaccctgtctcaaaaaaaaaaaaaaaatcaaaagaataattcaggatatgtgaaattcaaatcatatgtccataagtgaagttttattgagcacagccatgctcaacctcttacatattatctacggctgcttttgtgctgtagtaacagttgaatagttgcagagatcacatggcctgcaaagcctaaaatatttatcagctggcgctttacagaaaaagtttgcagctgggtgcggtggctcacgcctataatcccagctctttgggaggccgaagtggaaggatcgcttgagcccaggagtttaagaccacactgagcaacagccagaccccagtctctaccctcctccaaaaaaaattaaaaacaatctgggcatggtggcacgagcctatagtcccagatactcaggaggctgaggtgggaggatcacctgagcccaggattttgaggctgcagtgagctgtgatcgcaccactgcactccagcctgagcaacacagtgagatccagtctcaagaaaaaaaaaaaaaagtttgctcactcctgacctaaagcaatggttgtccacatggggcgattgtgcacagggaacattttggcaatgcctggaaacatttctggtggtcacaactgtggagggtagggagggcatcctactgatatctagttagtagaggccagggatagtgctaaatattctttaacgcacatgacagccctccagatgtctggtcccaaatgtccatagtactgtggttgagaaactctggattataggactctaaggtgagtactttctttttttttctttctgagacagagttttgctctgtcgcccaggttggagtgcaatggcgcgatctcggctcaccgcaagctctgccttccaggttcaagcaattctcctgcctcagcttccccagtagctgggattacaggtacgtgccaccatgcctggctaatttttgtatttttagtagagacggggttccaccatgttggccaggctggtcttgaactcctggcctcaagtgatccatccacctcggccttccaaagtgctgggattacaggcgtgagccattgcacctggccaggtgagtactttctagtacagggaaaactcagtccttaacaagggagcccactgactgaacgcccaggtctttaacttttagctcaggtagccttcacaatgaccatggcaaggcaatcactgatgtcctccttttctggagacgttttattaaatttttattttacttatttatttttgagatggagtctcactctgtcgcccaggctggagtgcgatggcgcgatctcggctcatggcaacctccgcctcccaggttcaagcgattgtcctgcctcagcctcccaagtagctgagattacaagcgcgtgccaccacgcccggctaattttgtatttttagtggagacggggtttctccatgttggtcaggctggtctcaaactcccgaccccaggtgatctgcccaccttgcttacagctcacaagtctgtagggctccagggcttgtaattttccataacacctcagtgcctgcctctgctcggtgacgtcacaaacgtcacagacgtattgtctcactcggctgtctcctagtgtgtgagctgcgcagagccaggcctatatacatggatattttctgaagcctccaggcctctgtaaggaaaggatgcatgccctgatgtctgcaccctggcccttaggaaaacaaagttgaagaaaattcgttttcctaagggccaccagagttctttaaagtgatgactctctctcttgcctactttaatgcttaggaggatgggaggctccgctctctagtagacccaggacacaaaatactccttagtatctatagaatgctttttgagtcataaagaatagtcatatccatgaattttgggggatgctcacatcacaggattaaatgagagaagacacgtggcatagagttcttttcctgccagaattaaaactcacctgaatcttgttccgtaggctctggcgctccacattctccatctaatatactaaatgataatcagctcaacttagttgaatccatgctaataaagaaaaagtggaggacttcctgcccacctccaccccaggtgttgggaatttcaggcccagctggaataaagttggagggggcgggcacgggggatggcaacccatctaggaagatttcataggctggtggtgcctccctgagcccttcaaatcacccactcagaaggcagccacccactcctcaggcaaaccgtggtgggccgcatcacccagtgacttaagatcagatcacacagccatttagcatttctttgaattttattgaaaattgacatggacattagaaaggtatcaggctaaacagtgctggttctgggatgtttctcctggagaatgaaagccccagaggggcaatgactggtcacacctttgagcaaaaagaacaaaggagaagaaaggaaaaacacacacagattctggaaaacatgcaaagaggctctctcaagagacactgaacagcagaatggtggtgatggtggtaggggatatatgagaatgagcacactcacatggtattttgatgcaagttaaaccaatgaattcaaggcagatttaccaacatcaaagctctccctccagatcccaggttgagcagaaacctctctcaaaaccctaactggtctcggaaggtggaatggagtaattttgccctcactaagcttaaaccccctcccttctctacctaagtgttagatagtggatacattttccccctttgctggaatctatagaaggtctgcgaatgctgaagaagatacaaatgtcacttgactttctcttgcatattcagaaatgtttaacagtggctgtagacagtcaacccatcgaaccagagaaatgtttaaaagaaaaacataaaactcaaacaaaaccttgtgaacagaacagtactttcatacccacagctgaggtgtcctgccccagtcacttacacttgggtgagtggtcctgtagttgtttctctgaggttacatttcgtccattttccagctctgatggttcttttcctgccttgttagttaggacaagacacttccatttaaaataccatgtgagtcaggaagagagcttcttgcctggacacagggacacatgaacacttgttgagtggtgtggtgtatgtgtgtgtgcttgcagtttgaggggagaggaaattggttgatttctgatttgagacaatatggaaccctaactcttctataatggcagtcttctcctttagacttagtgcagctgctgaagacaagattaaaaaaagctggaaaggagagagaaagagaaagaaaacatgaaattagccaaagaaagaggacattcaaagtaagacagggggaggggaatgggcaatattgaggtagcacagattgtagtgtgagaagacaggttagaaatgggggtcattgctgggccatcaccacggggaaatctgctgagaaggttttaagaacaccacacaccagtttaaagcttcttgttttaattaaaaacaagcacatattaacagccacatgtgaatgccaaatgattaaaacaaaaaaacaaaaacaagagccatctacactgcagctagggaaagcaaacttcttggcttaagagaagtgagggatgtgtgtacgtgtgtgtgtgtgtgtgtgtgtgtgtgtgtgtgtgtgtgtgtgtgtgtgtttcagaaaagccactccagtctgggaaaataaaagcacagaccatttctaatgactggttttgtttcaccagaagtaaacagagtacttagggtattttttttttaaatagtaacagttgtactaatttaaaagccttttcattgaagaaggaaaaaatctgtctacagtgagaaaagctacccaatgaaatacacattttaataggttgatcaactttttaatttatgttcactcatgggttcgatttttgttcaccaaacttccctgattataagggtcacctagggcacctgttacacacagtctcctggaccccgttccagccttgcagcatcactgggtcattgggttaaggagctggcccggcatgccttcgttttgccagccctcacccaatccatcttcagatgtttttctgtggaaaaaaacctcgagggtcttctaatactaactagtcagttactctgaacatcaaaagacctcgtatccaggaatgtaacgtatataaacagattgaatccctttgtgaaactgattgggagtcaggaggcatgaaaattagtctggcttctgcctcgaaacagaagtgggacctcggtcaagtcccttcccttctctgggccttcatttccccttacggagtaagtaggttatatcgtcttactgactaaaatgtctcccttaatataaaactcctccttagtttctgaaggtctctccaaggctgtgtgggtctaatacttttgaattattcagagcttctcaagccttaactagttaatctgtacacaaatgcaaatgagggcgcctccggtttgtaatgcaaataattaccgggcggcggtgtggggaagtggtggttaccggttggttgtttaagcgtgaatttctgggaaagcagctctgaagctggacatagaatcatcaaagttgcaaatatgaagcctttcccaaggagacctgacaggcctaactcagcatctctctgagctactggctgagtatctgagcagatttttttttttttttttttggtcgttggtttgtttctacctccaagcatatggtcttcaaaaaaatactccactgtaacttgaattttcccaagaaactggcttgtgctttggcagcatcaccttcatacttgctctggtcactcaccaatcaatagagcaccaaacctacacagcaaacctatattcttgctttgtcaacaagaaaagtgcgtgcatatgtttgcttttcatttttttctttttgcttcctattatgatctataattgaagtgagaaatccccttccccttctcaatacttcaaaaaggcctggaaatttggcataaccttgtttgactgtgtgctttgaaagtaagtgatcaaaaaaagaaactctaaaaaaaaaatagaagtaggtggtcatggtcagtgccagtggggctgggaggcaggagcaagttgcggaactcaaaaagaagaagtgagcttgaagtacatggcaggataggggtggggggcctcgctgcctggcaccccaaaggaaagctgtcagttaaaataggaacctcggcttaaaaggctaaatggagtccagtccagctgtagcggggaatactattcagtacacagccatggattactgcaaaggaagggcagagagacggcatgttagccacagatcattgccaggtcaactccatctctcacactgtcactggccaaacaccaaaggccactgtgcctcataaccctgacaagggagggctctctacttcacagaggttcccaaagccactatcagatgggacccatgataaaaacttagggctggaatatttttaaactctcaactccttaaattggaaagaaagttaagggccttttcttctctccggccgagtctcatctcttcttattgggggatgcatgcaaaatgcatgttaaaaatcatcatgacattcaccaaatgaactagaagactcatcagagcaaacccccaaacacttgattcttttgacagctcagttttccagcctacaaagtgggatttattattcctgctactggcctcaccttattgggacagtatggagcccttccggaaattaccccccgagatgctgaaatacctcacaagaagaattcggtaaggctatcattcaagactctaggctggtaataatattcaggtttattctcccttttgcatctgtgggatacccagagttagagagaggggaaacgtctgctattttcttcagcagttgtgttttatgggaagggcttggtgtaaataaatgcgttgccgattttgagcacagcttgagtgcagttacttcgagtgaatgaaaactggaaagggctggactcaaaggttagaaggaaaaggcgccaaaggctgtccttttgaaaccctctaagaaatggctgtggctcctgaggatgagggtggggtggaccagggaggactagtgactgggatacaggagaccaaggggacagctgtgctgatcggtggttacccagccatggtggttgcaaatacctcagggaaactaacagcaaccagaactggaacaggggagctggtgggaaagagtagcagatgggccccctgaccatgtcacacctctggcaaagatgtgggggaagacaggggggatggctgggggtgctgggagggggactgggatgcaggatgcatctgcgagccacatgactgttggcttcttgaccagcggccagacatcaccctcagattctcaggtttctataaaccttggcaggaagagaggagagggcgcgggttggattgtatgccccccaggcatgttaagggggaaattagagaaagggaggcccagctctgttgcgcaggaaaagggtgtctacaggaagcccaaactgaaaatgaaaagagaagctgagttaatgaatggatagattaatgtaccaaaaaaaaaaaaaagtcagaagaaaattaagtaatgaggactaatggctaaattagaatatagctatgttagatggtcttaaggtcttattgcattggctccggggaacatgctttctctctcatacactccacacacactcccacatgatggcagcagtggcattagccagcaaaataatgatcaacaaccacaaaaatacattttatctttctttctttttttttttttttttgagacagagtcttgctctgtcacccaggctggagtgcagtggtgcgatctcggctcgctgcaagctctgcctcccgggttcacgccattctcctgcctc[222 bp omitted]tgcccaggctggagtgcagtggccgtgatcttggctcactgcaacctccatcttccaatttcaagcgattctcctgcctcagcctcctgagtatctgggattacaggcgcctgccaccacgctcggctaatttttgtatttttagtagcgacgggggtttcatcatgttggccaggctggtctcgaactcctgacctcaagtgatccacccgcctcagcctcccaaagtgctgggattactggcgtgaggcactgagcccggcctatctcttcttaatgactaggtcctgactagtgtcccccaccacccacccccagcaccaccacccacccccagcaccaccacccaataccttgtacaggaataccttccacaaatctctaagtggcctcaggccactggatagagccccaggctctagccactgcatttcctgtcccattgggaaagtagaggaggctgaggtttcaccccaggagatccttagagctgtcctagtcagctaactggtactctggggcaagacctgtttgcagagcatatggggatgattgcagaactctgttctagggtccagaccacagttacctgaaaatgtgaactatggaaacccatcattggtttgtgcttaaataatactttgacctctcttccatgtaaatttcattcctgtgacataaatacagcaagtagaactgatccccatttcatatgagtagaccaagaaacacagagaagtcaacagacttgcctgtggctgcaaagagtcacagctgggcccagagctggtgtgtgtgtgtgtgtgtgtgtgtgtgtgtgtgtgtgtgtgtgtgtgtatttttatttcttttgagatggagtcttgctctgtcacccaggctggagtgcaatggtgcgatcttggctcactgcaaccgccgcctctggggttcaagcaattctcctgcctcagcctcccaagtagctgggattataggcacccgccaccatgcccagctaatttttgtatttttagtagagacagggtttcaccatgttggccaggctggtattgaactcctgacctcgggtgatcctcctgcctcggccttccaaagtgctgggattacaggcgtgagccatcatgcccagccaactctcttaaaaaaaaaaaaaaaaaatagagagatagggtttcaccatgctgcccaggctggtctccaactcctgggctcaagtgatcctcccacctcagcctcccaaagtgctaggattacataagtgagccacctcgcccagcttccatttactcatcttgcaaactggggattattccttctctacctcacagacctgttgtaagtataaaatgagatactatacaaaagacaaaaacaaaaacaaaacaacaacaacaaaaaaaaacactttggaaagtaataaaagctatacaaatgctcatatcttatttttattctttgtctacttcctaggggaagagtaatctaaaaaacactgcaatggcctatgttctaggtttcatgggaaggctgacgtattttgatgtgtgtatactatccatatactgtgcactcctaaggaccaataatgattgaggtagagtatctgcaacgatgtagggggtcacaaaggaatcgcttttacaaatgcagagagctataagtagtgcctcaagcaatttcaaaatgtggaggcacagtaagcctcactctgcctgcattctaggtggccttcgtgatccaccccttgaatgagggctttgaggagggggcgggttgcctttgctgctttcagatcctggggagccaaagcctcccctgactcgttggtctgaaattgctttcgtggtctgccagggagaatcctgccaggaagagccaacctacttggggttggggttggctgttccagctgtttaccaattgcctctcacttgtaaagtgtagctttaattatagttttgccagaattcattttaggaatggccactaacaatgatttacttggggaaacctgtaagcaactgtgtcaagccacgtgcagtgaaacctgaattaactgaaatctcattaactagaatacatatttcctgctcacctcattaaaaatgggagaacaaagaacataacacatgaactgagttcctattacatgtcagacacttcactacgcactggaactacatacagtgcaaagaatggacaggcattctaggaactgactgtcttcctaaatggaaatctgctgtttaattccagtcaactagcaggggctccaagacttgctgttaagccagacagtaaatcaagtcactgttcttttaagattgtttcctttggcccggtttcatgggccttatgttgcagaaacctctatggacttcctcttcaggatttgcttccaagcaggatgttttgccagctgccccgagtccccagtgcaatagctgcggcaatcagtttggtgactaacagcaggctctccatttaaatcataaactacatgggtgagtggggaaaagtcttctctatattttatattccctgatccaaacaaaccaaatgtaaaagggcatttatgagacaaccgggatgtttcaaacactgactagacatttcatgttaatgaattattgttcattttgtaggtgtgataatggtggggttgtggttatgtttttttaaagaatcattatctcttggaaatatatactaaagtatttacagataaaatgatatagttttgctttataataattcagcaggtctgtagtaattgatgaaacaagattaggcatatgtttatggttgcctgggggctgaactgtattatcctcttattttgctcatgtttgaaagtttccacggtaaagtttaaaaaaaataataataacccttcatcgggcgcggtggctcacgcctgtaatctcagcactttgggaggccaaggtaggcagatcacctgaggtcaggagtttgagaccagcctgggccaacgtggtgaaacccggtctctgctaaaaatacaaaaattagccaggaatggtggcacatgcctataatcccagctacttgggaggctgaggcatgagaattgcttgaacccaggaggcggaggttgcagggagctgaggttgtgccactgcactccagcctcggtgacagagtgagactccgtctcaaaaaaagaaacaaacaaacaaaaaaaaccctaattatgttaaattaaaaatgtttgtatttcctttccatccactacctgagtctagtagaggagatagaaggtccttaatccctgctttcagtctccctataaactatgtgaaactttataaacttctattaacacaacatctagcactcaggaatccttacctgctgatctccttataagaggttttcatgaagccagtacttgtaggattaaatgtaaggaattctctataatttctaagatctcttcattttcctccgcttttattatgggttttttttttttgtttttttttttgtttgtttgtttgtttgtttttttgagacggagtttcgctcttattgcccaggctggagtgcaaaggtgcgatctcggctcactgcaacctccgcctcccaggttcaagcaattctcctgcctcagcctcccgagtagctgggattacaggcatgcaccaccacgcccggctaattttgtatttttagtagagacaggatttctccatgttggtcaggctggtctcgaactcccgacctcaggtgatccgcccgcctcggcctcccaaagtgctaagattacaggcgtgagccactgctctcagccttattatggttttgaggggtacagtcaaaggaaatttgaggacttgaacccctcagatatgaaactgccaccagcgggaaacagagaagtgagtttccattgactctggacattctcaaacctgatgcagggggatgggagagggttgatgctgactgtgacattgcaggacggagcttgtgaaacccagtttctctcatcaccacggtttcattaattttgaaaataatggttatagctccttttgtttttgagatggagtttcgctcttgttgcccaggctagagtacaatggtgcaatctcggctcactgcaacctccgcctcccaggttcaagcgattctcctgtgtcagcctccagagtagctgggattacaggcctgtgccaccatgtccggctaattttttgtatttttagtagagatggagcttcaccgtgttagccaggatggtctcaatcttctgacctcaggtgatctgccctcctcggcctaccaaagtgctgggattacaggtctgtgagccactgcgtccggcccgattatggctctttaagaaaaaaacttcccacactgaaacctcaaatactgatcacaggatccacctgtgttacccagctgttctagcagcaaaagtctgaaaacgacccctcactttaatcaggcaggcaggcaggcattccacatgtacacctgaaaccacaccagactatttctgcatattataagtcacgagagaaaaccagctagaccaatgaagcagcttcttctacgattagatgcttgtgttgggggtgcgggattgggggagatatgttctagaagccactgccagttctatttagagttaatcaagcttaccaggaccctgggtctcatgcagcatgcagcaaacagcagagttaactgtaaaacagtaagagctgatgaagatggagtgagcatgaggggaaatcaaatattatgacttgacacaaacaatgaagggttagaggtcaaaggtgattaggagtagcaggaaggggaagtgggaagggtggactggtaggaacccctgaaacactgatactcttttttttttttttttgagtcagggtctctctctgttgcccagactggagtgcagtggcgcaatcatggctcactgcagcctcaacctcccgggttcaagcagttctcccacctcagtctcctgagtagctgggattataggcaagtgccaccaggcccagctaatgtttatttatttattttttttgtagagacaaaggtctcactatgttgcccaggctgatctcaaactcctggactcaagcaatccttcgccttggcctcccaaagtattgggattacaagcatgagccaccacggctggccagtactttcttaatctctttaggggcagctaaaggaaattctgaatatgtgactcttagatccaaccaccatctctcaagaagaaatactactaccaccatttctgccctcaaaactcactaccgtgactatgggaggagggtagcacaggtctaacggtggctcttccagaagttaacaaattgctcatgaaattacataagaagccaagattcagggccacttctgcatctggaagtacagaagaagacaggtcattctgttaggcccttattgctaatataaggtgccacatgccagcagggttttcacccatttcagaattggaaaggggcactgtcaccaaccccaaatattcctgaagagtagagaggggtatctccctgttggggtctcctgcctggggtgggagaagtcagtcagtatgaggcaacaaggggaaagcttgatgtaagaagaacttttactgaacatctgaatagggaatatttatagtttcattgtagcctgaacaaaccaattcctaactcccacaagcaggctatgaaactgccccaggtactgagttaacaaataccacaggactatgaaggcagcaggttacagctggatgacaaatttagatttttctgatcttaaaaataggaattcattcctgctggtgcaactaatacaccatgacagataagttaatacagtacagggtgtgtccaaagagacttttttctggctagttgaactttatccatcaggtaataccaaaaaatttcattcatcagtgaatttgacatatagtattaagattcagtaagaaaaatttctggactaattggtgaagatgttctttttttttttttagacaaagtctcactctgtcacccaggctgaagtgcagtggcatgatcttggttctgcaacctccacctcccaggctcaagtgattctcctgccttagcctcctgagtagctgggactacaggtgtgggccaccatgcccagctaatttttgtatttttagtagagacggggtttcgccatgttg[135 bp omitted]tgcaaagctgaatgccttcaaatataacatattttactgttatgcaaaagttaccatgttattcctaagtgataagccagaggaaaggaaggtgtttcttccttctggcaaaaatatcccatagttaagtccaggaacaaatggctgaaaacagaaggcaatgaccatggacaccttttggatcctcagtacccttcagtaaagacacagctaaacagtccacctgggaactcctcaagccacactgcacaaacaactgcagggcacaagggcaccacaggagtttttctagatcccgttgaaatatttttctccagttctgggatgaggaatgggtaacttcagcaagcagagactggggttgggtgaggattattgacccacatggtatccaggagccactgttctaataccaggggagatcagaaggtcttacagtcattccacagattgaggatggggcacatgcagcatacactggcatctgagggctcccccataagttctcagcaccccaggctaggcagaactaagccagcagggagggatcacaaaggggtgggaaatcagggctgagctgcagccttcactggcagcagttaaattctgttggctgcagagagtaataactgaggcagggtgagggtgggactacggccatggagaggtgagcaacctcagatatagggcaagggtggggagagggtgcaccgag[138 bp omitted]cctctgcctcctcagttcaggcaattctcctgctcagcctcccaagtagctgggattacaggcgcacgccaccacgcctggctaattttttgtattgttagtggagacaaggtttcatcatgtaggccaggctggtctcgaactcctgaactcaagtgatccacccgccttggcctcccaaagtgctgggattacaccacgcccggcccgtagctgcagttctttttgttcctctctttcttttctatttttttttttttcagatggagtctcactccgttgcccaggctggagtgcagtggtgtgatctcagcttactgtaacctacacctcccgggttcaagtgattctcctgcctcagcctcctgagtagttgggactacaggcagctaatttctgtattttttttttttttttagatggagtctcgctctgtcgcccaagctggagggcagtggtgcgatctcaactcactgcaacctctgcctcctgggttcaagcaattctcctgcctcagcctcctgagtagctgggattataagcgcgcgccaccgcgcctggctaatttttgtatttttagtagagacagggtttcacca[137 bp omitted]tgcctcagcctcccgagtagctgggactacaggcacccaccaccacacccagctaatttttttgtatttttagtagagatggggtt[132 bp omitted]agacggggtttcgccatataggccaggctggtcttggactcctgacctcaagtgttcctcctgccttggcttcccaaagtgctgggattataggtgtgagccaccgtgcccggccttgttcctctcttatattgctgcacctctaatttttttcttcccttctgctctctcactctcctttgcttttcctcttttcccttcctttcctatggaccttgagtttgcagggctttcctgagcaagctggacagatgggctgggcctctgggaccacacccctctgctactctcaactccccaagctcagggaatccaaaggtgccacagggatgctgggaccagttataggtacctcaaccagtctgacagcccacagctcacctctggtcaccagtcctcagccccttcaggtgccacgtcctgccctgggaggatgagcaggaggaaagagaaggcaccaccccagagcagcctgctacttactttttcttctctttgtctctcttcagagtctgtgagcctccagcctgggagccctgggactggagcagctcagccgccgtctttctttgcttgaaagcattcacttcatcatccagggatttcttcttatcctccagtttcttcttctcgtcctggtgcagtttcttcagacggtcaaacttctcgtgcagctggcagggaagcacagggagattggagagaatcccctgtgagcagtccccagcctggccaagcccaggtgggtggggaccagtagggctgtgaccctgcaggaccctggaacctcagggggcatttctgtcagggattgctatgatggcaccaaaggcaccatgctctggatcgttctctcttcctgccattttatctccaagtctctgctcctgaatatggtaaaggaatactgcattgtgtttagtcagacattttgttaaaaagagtccccatagttaccacacatggtcaataataacatcaattataataatataacatttactgagtgctggccgggctcaggcctgtaatcctagcactctgggaggcca[134 bp omitted]gaggcagaagaatcacctgaacccaggaggcggaggttgcagtgagccaagattgtgccactggactccagcctgggcaacagaggaagactccgtctcaaaaaataaaaaaagaaattaccgagtaattacaggctaagcactgacttttataagtcctttatgtatattaatttatttaattgttaccacattcctatgaggtaggttccgttattatctccattttatgaggaaacagaaggtctgagaagtaaggaatttgactatggtcaacccagtatttagaacattatataatgggacctcttatgtgtaaggaacccctgtcttttcttaacccctgcaatcaggaaggatcaccatggatctcagagaaaacttcagtatgggaaagccagtcaaggaaatacttggctttggacatggaaggaaataaaaaggactttatgacatggaatgagtacagacacctcagccttaactaaagggaggcttaattagtcctgaatagaaccagaaacccaaagaagaacaagaagaatattctgggccaggcacagtggctcacgcctgtaataccagcactttgggagtgctgtaatcccagtagtcggctcaatcccagcactttgggaggccaaggtgggtggcataaggtcaggagttctagaccagcatggccaacatggtgaaacctcgtctctactaaaaatacaaaaatgagctgggcgtggtgacgcttgcctataatcccagctacttgggaggctgagacaggagaatcacttgaacccgggaggcggagctttcagtgagccgagatcgcaccactgcactccagcctgggcaagagtgagactctgtctcggaaaaaaaaaaaaagaatattctggcatgccattgtggtaagtggatcagagaacaagaggcacagacagtcacaaactagaatgcaataaactaccctgaatagtaagagcagagcaagccgaatttcactttctttcatggattcaggagagagtttaggattctgtagcacttgcagcatacgatgaagaaggttagttctccgggtcctgggggtatttggcactgtcacttaggtg[142 bp omitted]ggttcaagtgattctcctgcctc[133 bp omitted]tggcctcccaaagtgttgggattacaggcatgagccaccacgcctggcctaaagcagctcttactagtcactagggctgcctatcaattgccttaacctggtttttgtttgttgcacttttattcatttgtctttgagatcccctcacttctcctcctaaaagtgctgggtgacatttttgttttttttattgagacagagtctcactctgtcacgcaggctggaatgcagtggcctcgatctctcggctgaagcattcctcctacctcagcctcctgggtagctgggactacaggcacgtgcaaccatgcctggctaattttttgtatttgtaattattttttttttttgagatggagtctcgctctgttgcccaggctggagtccagtgggacaatctcggctcactgcaacctccgcctcctgggttcaagcaattcttctgcctcagtctcccaagtagctgggactacaggtgcgtaccaccacacctggctaatttttgtatttttagcagagacagggtttcaccatattagccaggctggcctcaaactcctgaactcgtgatccacccacctcgacctcccaaagtgctgggattacaggtgtgagcaactgcgcccagccaattttttctatttttaatagaaacagggtctcagtatgttgcccaggctggtcttaaactcctgggctcaagcaatcccctcgctttaagcctcccaaagtgctgg[131 bp omitted]cattctcctgcctc[225 bp omitted]caatacccttgtcatgggctttggtgagaacccttgagagtgtgacaggttaaatgtggaagagaatcgtgaagtaattaagtgtttcctttctttttttttgtttttgagatggagtcttgctctgtcaccaaggctggagtgcagtggcatgatctcagctcactgtaacctccacttcccagattcaagcgattctcctgcctcagcctcccaagtagctgggactataggcatgtgccaccacactccactaattgttgtatttttagtagagacagggtttcaccatgttggccaggctggtctcgaactcctgacttcaggtgatccaactacctcggcctcccaaagtgttgggattacaggcgtgagccacagtgtccggcccaatgtttggatttctgttcctgtgttagtttgctgaagataatggctcccagctccactcatgtccttctaaagaacatcctctgattcctttttatggctgcatagtattccatggtgtatatgtaccacattttctttatccaatctatcattgatgggcatttgagttgattctatgtctttcctattgtgaatagtgttgcagtgaacatatgtgtgtgtgtatctttataataaagtgatctataggattgctgggtcgaatggcatttctgattctaggtctttgaggaatcaccacactgtcttccacagtggttgaagtaatttacattcacaccaacagtgtaaaagcgttcctatttttccacagtctcaccagcagctgttgtttcttgacattttaataatcaccaggctcacatttacctctttctctgcctctttgagctccgcttctttctctttgactcgctggacgaacatctgtctcatctcctcttcttttttctggagttcccctaggaactcgttccttttggcctcatatgtctcctgtaaactgcgaacatggtcaggttaattcttcttcctttggaatgattcctatttgataaaactggccccaaagatcctcactgggttcctctgtcctcccttccccagttgtgagccaggtacaaaaatagaaccacaaagctgtgggcacctggcttggcccatgacagcatgcccacagggattctggagggggatggggcaaccctagtgaactggagagacttagaatatctggttctatactcttgttctacggatgagaaaactgaggcccagagaggtgaggtgtcttactcaaggccccacggctagttagagggagaactttgaccagaagctgagtctcctgtctcttcatctgggttttcccactgcacaatgctgccaggccctggctctgaaactgaccacattaatgaactatttcaacaaatgcttgaggagactccatatgtgctagactcagtactaattgacatgatgctagtcactcagcctctagagccaacagccatcatacctgccatcaaggaactcatggtctagtgggagatgcccctggcctaagcttatttttaaagaaataggagataggctgggtgcagtggctcacgcctgtaattccagcactctgggaggccaagacgggtggatcacctgaggtcaggagttcgagaccagcctggccaacatggtgaaaccccatctctactaaaaaatacaaaaaattagccaggcgtcgtagtgggcgccagtaatcccagctactcgggaggctgaggcaggagaatcacttgaacctgctaggcgaaggttgaagtgagccgagattgcgccactgcactccagcctgtgtgacagagtgagactccatctcaaaaaaaaaaaaaaaaaagcaatagcctggtgaagaagaggtggaactgtgatccaaagagggcagcatgtaagaaagcaggtgtgaagagagaatgacattcttggggagccaggtatggttcaacatggccagagagcaccatggcagtggtggagtagaggcagacaaagttcctgagcctggaggaagagaacaggctttgaatgccatatttaaaaattggatatgtacacactgcatggttttaaagcaggaagtagtactagatccaatttgaaaatgagaaggaccattccggctgtgctgtgggaaggatagactgtccatcaatccaagtaagaagtgacaggatcttggccaggtgtggtggctcatgcctgtaatctcagcactttgggaggccaaggtgggtagatcacttgaggtcaggagttcaagaccagcctggccaatatggtgaaaccccatctctaataaaaatacaaaaattagctgggtgaggtggtgggcgcctgtaatcccagctactggggaggctgaggcaggagaatcgcttgaacccgggaagccaagat[131 bp omitted]gggaatggagggagcagtaagggaagcagaactcccaggacttgggaggagccaaaggtaattctgattatccttgggcaaccaggtggatggtggtatcatgaatggcaacagggaatgttggagacacatgcttaagagggcagaagatgaatttgtacagagcttgattttcggggaggtcctctatgggatgtctgagtggacatccaggatgcagttggattaatgggtttagacctcagaagtaagactagcttgggaaccatctacttctaggtggtaattagggctgtgagagtagaaagaaccagctgcaaagagaacagaaagtgaaaggagcagaggctctaggaaagaatcccggggggtatatcaacatttaaaggagtaaggtgaagaaaacgagcctgcaaaggaggctgagaagaaatagtaggagagataggaatagaatcagccaggccagtgctagaaaagccaaaggcagagagcatttcaaggaggcagtggggaatggcataaagtgctgcgttgatatcaaataagatggaaaccaaaggccacattgaacttggccacaagtctgcgattcctggccttggagagaggcatttgagtggttatgctggggacagaagccagactgcagtggattgaggaatgaatgagagatggggaagaggaaccagtaaacatagaacaactctttctcctcatcctgtcaaggacttcttgacaggacagaggctggtaagaaagagcagggttaagggagagtttcttcagcacaagaatgcttacatgcagcatgggaaggagctggcagagaaggagtgaagaaggcgaagacacaggaaacagaggtattcaggatggagtgaaggaggagggaaggagacaaaatgaccaggtggaggcacacctactcctctacaaatgcagatgaaagctgcaggtggggaagacagccagggagctcccaccagaaaaagacaagcatggcttcccccagccccacctgtcagtatatagggcatgagcctgtccctcctgaagcaaatatccccaagggactggttaggctctgactccaggccagctttaggctgtgcacaggtagagtaagatctcagaggctctttgaaagcctttttaactggtagacatctccctcacttgcttattaatgcctgaccaccataaagggcaccacgtggtaatttcaactgtggggcttatttcacacatcacgcatatagatcagacacttctacttggcgcattactcctctctgcataataacctgctttcaaaaacattccccttctctaaaagcattctgatttaagaaatatggcagtgatgatcaacatcctgcggtcaaaacagaacttgcacttgaatgcagacactaaggacagcaattggagagcctgcagttcatcgatgcatggcaagggcatgctacctggtcctatctgggtttgagaatggggaaatgggtaaagaacagactagaaacctgtctgagcgccaggagcctgatgaagaaagaggggcagaggacagttaccaactgccacctcgtggaacagggccccagcttggggattccccccagcgcagctgcttggagctgtcatggatgcgtgcatgtgtgtgtggtgatcagccttgctggtcctctgggcatcctcccttcccttgcccttaaaagcaaggcggcggtacttcccaagcctgctccccacagctctcctggcaggtgtgcagaggcaaagggtgaacaggcaagcagaactggcaagtgagtcgcccctgctccttgaggtcttagcacccgtgtctcgcctcccctgtgaattctccaggggaaggcttccacaccacctgagtgggctgagctgagctgggctgggctgggctgggctggcaggagcggtacctgaagggtttgctgtcagggtcggtgtccttgaagcccatctcctccagcttacagcggcgatacagctcatagtgccgggtgtgggtctgctcccgcagatcctccatgttgacccgaatcagcatctcccgcagcttcacaaagtcgcagtgggcctcgttttcaactgcatagcaggatttggggtattgaaagtatgttgaaaggaaggccagcagaagcagaaatggatgaaacgagaggcaaaatgtctaacagtgacgttgccttgcaatctgtgtatttagatcctgcaaatttacctcctctcttttctactgaaaatgtaaatgaaaggttacaaaaatgccagtaatgaaaaactgtgatatcataaaaatacttattaagacagtcagtagcaccacaatctaaattcagcagtcagaaccctcaaaagaatgtttggtctgcaccacttgtaggacaacagcatatatgcatctgtccatccatccatccatccatccactcatccatccatccatctatccatccatccatccatccatccatccatccactcatccatccatccatccatccatctatccatccatccatccactcatccatccatctatctatccatccatccatccatccatccatccatccatccatccatccaatcaatatttgtggaatctctgttcccagtattgtgtgaggcactgggaattcagaaacgaagtgatggaatcttgctctcaggagcttatagtttagaggaagaatagatacaaatagacaaatacaattcagtgcacaactacaaaaatagagggatagccaagttgcaataaagctcagaagaggggaacctaagaactcctgggaaagtgaagacttcaccgaagagaaaatctctaagatgactctggaaggaagaatagcaatttatcagccagagaagggaatggtgtttgcaaagtgtcaatgaggctaggcaaggttatgtagctagtaagttgcagaattagggttcaaacccaggcaatgtaggggaggtgacaaagtctccaaagaataaggggaaagaactaggatattgatagatgacagtgacaaggaggggtgtggaccgcaggcatggcccacctggatggtagaagcttccaaggaggtggtttctttagaaggtagataatggcctgacagtagcagtggtgactaggagcaaggggaccccactttctggcctgtgtgaacaagtcccctcctcaaaagagtgcaagcaaaggtctgcaatttggggcagtggtcaagaatgacagatgtggaccaagtcatagcaaaatcgatttctggctggaccaggtcacgaggagcactttgtcaaggtggctacaggtatggcttcactgtgtcggatggtggtatttgccctgaacaagtaggaaaaatggtgtctgaagtgaacaggcaatcaccccagattctgtcttgcagggtctggaagagggtagtgagggcagagaagggtctgggataagtgggtcagccatagttgaagcagactaccttgtggtcattaatctttccaaagcccgaatcagctcacataatccctctgcttaagacccactgaattaggaataaagccccctgctgtcatagaacacaggctaatattaaagatgacatcagtaagacaacttctcaggactatgctatatgccatctcctcctccatctctggacagtgatctctaatggtgagtcagaaggagtgcctccgagggccctgcaggctgcctgagcaatatacaacttcttcctcattcaagcggaacagtcaacttagacttacaagaaaaactttcaaaacccccttttctgtttaggttcagagtagtccacatcagatgaaataagtcattggaaccatgtctactggcttctcctcgtctcacttcaggttcctgtttctcagaccacaagtccattcccagggtgggacactgtgggtccagaaaccatttgcaaacgttcctagtggagcatccccagctccgaacagcagagaagaccagaacttagcacagctctgataaccagtcttgtcctacctatggaaaatccagctattgccagtgggtgtgtggggtgtcctaaaacatgccagccttcgtatgtgatgtggacaactcgccatccactttcaggtgtttccccagtggtagggatgagtttacagagaaccagccactctttcacacgatgcccctatcagccacggcccagtttctagctgtagactctgaggaccagagacctcttctacccacagcgccatccttggccttgtcttgtgcactgaactgactagccctgagggtaagttaacatatgtcaggcagatcacagaaggaactttcctgagtgtaatacaatatgtctaattgcttttcaattgtgaaataatcatacatacaaagagcatgaaatgtgtatgtacaatttaaagaatttttgaaaaattaacaccaatgtctccacaactcaggttaaacattaccagtaccttggaagcccctgagtgccctttcccaatctcatccccctctatccctcaactcccctggcagagacttaatccttctcctgactttggggattatcattcctttgtttttctttatagttttacctcttatgtatgcattcctaagaatatatatcttgtttagttttgcctccttttggaattcatacaaagggaatccaatggtatgtttctttctttctttttttttgaatctcactctgtcgcccaggctggaatgcagtggcaaaatctcagctcactgcaatctctacctcccgggttcaagcgattctcctgcctcagcctcctgagtagctgggactacaggcacatgccaccatacctgactaatttttttttttttgtatttttagtagaaacggggtttcaccatgttggccaggctggtctcgagctcctgacctcaggtgatccgccttcttcggcctcccagagtgctagaattacaggagtgagccaccgcgcccagccccaacacgtagtttttttaaatcccttatccccctcccaccctcccactatccagtcttttttttttttttttttttttttgtatttttagtagagatggg[145 bp omitted]ttatttgtcattacaaacaacactactgtgaacattcttcaggtgcacttgggcaagaacacatgctttttcgcacactccttcctaccttgcaagtccttgtgttttaggaatacctttcccattagaaattagagggagcttgctcccatcagagcatcccagtatggagccagagttagcttgctagtgacccctatggctatttgggacccatgccgaatgagcagagacttgggacaatttagaaacttgtcatatagtggctggggacaaacaaagagacagacaaaaggggcttcctgtgtgtagcccttcccggagactcactcaccctgcacagtgccccaaggatactgccgcgccctcatcatcttgttgcctatcttcagttcttctgtgctgccaatgacagcaaacggcaggtgggcctgaaaccgaaggcaaacgaaagctgagaactgcagaagaaaggcactgagtgttacacaacccaactgctgttcgtctctggggccccaggccctcaccctgcaatgtccctcactgtcatcatcaccaacaagcatttattaagttcccaaaccatgtgaggataagaggcctagtccaagcctctgctgttcagaaattcacaatagagggtaacaatgacatggctgaatgcatagggaacaaagagagaaaataagcagaataataagcagacacacagattaccaaactattcgctattcatagttactgctgaggggaagagcctttggaagaaggggaagtggaatgaggggggttctgtgtggatagagaggataaaggagtaccaaagggtctgggatcactggcccttctccctccctggcatgcaagagccccaagactaggtccatactgagaccacacagccaactgagctgtactctccttgttctcatccttccccggagaaagagctcacattgaacttgtgagcctagaaggcaagtcaccaaggatttactcacatgaccatgctgggttcttctgtaggtgctataaggcagacagaagcagcagaagacacgctccctcgccctctaggagcttacagtcttgttgaggaagcccaaattacataactcaagtcatataagatagtatgtgatcaagggctcaagtatatggtctggtaccctgtacatagtaggtgcttaataaatacttcctgaatggcagtggtagggctagggaaagaggaaagaaaggcaaaggacaaataggtttatgagcttggtgctcacagggaaaatgaggagcttggcctggctttatggatgagagaagagagagctgccccgacttggcagtatggggcctaggaaacactcacagagccgtaatccacaaggagctagccagcttgtaagtgctaagtcaccacagccagatggaaccacggaatcaatgtttactgaccaggtgagcccaggtggggctttgcccaaaagggctttacaccaacaggtaaagagcctatggggaaagtttcttagcctgcctgcagaaacaggccatgatctcagatattctgacccatttgcccactcatccattctacaaatatttactgagctcctatgatatgtgctaggcattaagaatgacgtaatagcaaaaaagcacagaccctggccccggagagtgcacagtgtgccaagggagaaagccatctcaacaacgatcatacaggaagatcagggttgtaccagaagtggaggttgcagtgagccgagatcgcaccactgcaccccagcctgggtgacagagcaagacccagtctcaaaaaaaaaaaaaaaaaaaagaaaaatcaaggttgtaaacagaggctaaagggctggagtaacacagaggagggagcaattcttgggaagtcaaataagttgtttcagagtaggtagtggcaatcatactaacagcattagcattagcaataatttgttaagccctatgcactgggtaccagctgctttacatggcattgtctcactgaatctctacaacactatatggtaagttgccttattagtctcctctttagatggggaaactgaggtccagaagggctaagagacttgtcagcaggcacacaatagtaaggaacagaataacttcaaaccccaccccttgctggtctgctacctccatttagggggttcaagcagtagatgaggtgcgtactctaaaccttggggggaactagttgtgcaagaccagattatcagaggcaattcaattcagggaaacccacagcaaatctgtcgcttgtttgtttaatccacaggctgatctcacagtcaattcttttctccattctcctctagctctggaccccaaaaatgtccttcagagcagaagaacacaggatttcatcaggagctcagctccaggacctccaccagtccctcaaattgcttggccgccagctgaagctgctcttctttcaccctctccactctcagctgctatcagacgatcgtctcagacaccctccgacccctccccactccactgactgtcccttaaatctggacatgggaaagaggaggttatggattatggaaggtgggtgtggggtggaggtgggaaatgtttcatcagtcctgggaggggaatgaccaaaagagtaactgggcaagtgacacacagggcatttgggaagcactgaattcctgaaaatgctgcccaagggcctaagcatgtccaatctttgccaggagagttgatctgggcacaattcatccctactcagggacctaagacatatcgggagcctcgaatccacccctaaacactttctgggaggacatttcccctggagagaccccacagcttcagccacatgacacagaagagccaaggggtggcgaatgcagagagctagactgagggaggaggtgataaagaaaaaccacgttgtagcactccctcctcctgggctctcagctgtaagtgatggaggaggaaggcatgtgaattgggaggtgcttctctgagctcgaggaaaaaaaaaaccaagaagaaaacaaaggcatacaaaaatgtcagtattccctcgggcctgttgcatttttaccatcaagagacaccgtcagaatgatagggtgacttgcttccccctctttctcaaactgctgtcattttattcttctagctcaaaaacatagccccagccctcccacagcacgctcctttgcagctggcgtcagtctgctttgataagtatatgcaaggtaggcatttcccagcgctctcctttggtttgattttcacaacatccttctatggcaatgattaaaagatccattcgtgagctgagggaactgggatacatggaggttaaacgagttgcctaggtccctaacccccatgcccagatcctctgaagcagcagcgaggccaccgagctttggctgccaacctctcccagccacctagggtggtccgcactctgcctcctggctacatggcatctgctagaaggaagcaaaccatgacaagcaggaaatcatggggaccaggctctggccctctgttccactgcttttgagagacagatggctttgacaaccagaatagagtcgagcagagcagagagcagatacccaccctccccccgcaccaccacggaccatacttctaggtcctaccaatgggatccaaatctgaggccaggctttctgctatttttcccaggtctctgcaggaaactgacagacagtggtgacattttctatgtgtggacccagggaagagactctgatagatgcagggcagtgttgctgctgaaacacaaacaggcctctcaggagagtctgtgtgactctctcactcagacttccaatgaggcgccctcggatatcagatttcccagtgtcagaaaactccaacaagagatagtcgcaagccttccttgggagtccattcctagattcaccatctgtcttagtgcattttgtcttgctacagtaaactacctgagactgagtaatttatcaacaatagaaatttattcaaaaaaaaaaaatttattcctcatagttctggaggctgggaggtccaagatcaaggcaccagcattctggtctggtgaggaccttcttgccgcatcctcacacagcagaaggacaagc[138 bp omitted]ggtgaaacctcatctctactaaaaatacaaaaattagccgggcgtggtggcgggcgcctgtaatcccagctactcgggaggctgaggcagagaattgcttgaacctgggaggcggaggttgtggttagccgagccaagatcgcaccactgcactgcagcctggccgacagagcgagactccatctcaaaaaaaaagggccttcatcccattaacaagggagaagccctcatggcccaatcacattttttttttttttttaagatgagagtttcgctcttgttgcccaggctggagtgcaatggcacgatctcggctcactgcaacctccgcctcccgggttcaagcgattatcttgcctcagcctcctgagtagctgggattacaggtgcctgccaccacgcccagctaatgtttgtatttttagtagagacaggatgtcgccatgttggccaggctggtcttgaactcctgaccttgggtgatccacccgccttggtctctcaaagtgctgggattacaggtgtgagccaccgcgcctggccaggcccaatcaattcctaaaggccctacctttttttttttttttttttttgagacggagtctcactctgtcgccaggctggagtgcagtgacgtgatctcagctcactgcaacctccgcgtcccgggttcaagtgatcctcctgcctcagcctcccgagtagctgagactacaggtgtgtggcaccatgcccagctattttttttttgagatggagttttgctcttggtgcccaggctggagtgcaatggcgtgatctcagctcaccacaacctccgtctcctgggttcaagcgatcctcctgcctcagcctcctgagtagctgggattataggcatgtgccaccatgcccggctaattttgcatttttagtagagacggggtttctccatgttggttaggctggtcccgaactcccgacctcaggtgatccacccgcct[135 bp omitted]gcctcccaaagtgctgggattacacgtgtgagccactgcacccagccccgacctcttaatactatcatactggccacacctgaattttggaggggacacaatcaaaccatagcaccacctttactgacttgtgtctaacttaaattcttcttgtacattgtaaagtacttaataatccaattggcgtgagttactttattcttatttcaccacatccattatacttgggaggctaggtgactgcttagcccagtgaaatacacactgtcagaactctttattcctcatctaatgataatattctgattgggcttggtttcctcccagggtggacagtgtttcccagttatgttagtccccatttcaggcccctgctggtgactgaacaagaccattggctgatttgctctcaagtcaaccactggtgattcctgtaaaagtacatggcaacaatggaaataccattgctgtctcagaggaagggatggacttgtgcctgtgggtcttcctatgaccctactgttcagccatgtgttctcactgggcccaaatgtcaattgcctttgtgggaaccaaaccccagacctcacaaatggacaattaatggagctcagtcaattaagtaactgggcctttttgctggtcctggccatgctttcagccattcaaagaacatcattaaatttaaaataacatagcaattcttagtattaaagtctacaaccttgagagatatcagagcatgggttgaaaatagcatgcaacaagacctcgctctcccttctcttccccctcaatctacaataaggttttctggagccacccataattcaaggtggtggcagggacctcattactctcatttcctgccacaaaaatcccccatggtgagagacaggacattgtacagtcttctccactcaggcaacagatttcttccgcttcttccaatccagctcctatgacaattggctggggtggctgaggctgtggggctggagtcaaatccaaaatgaaagaccagcaccaattcctcctaccacccaagcccaggtcctgaggatgcagcttcatacaccacggcttgtgtgaagactctggggacttttgacatagttgttcggtggcaggcaggctaagcaatcctctgtgtatatttgatagcaccctctttcccatcacagcgcatgtaacacaaaacactcacatgcaagctcctctcacaggcatgccaattcaggcacactagctgtgaggccactcctctctttcccactcaaaaaaaacccatagtggattagccgggcatggtggtgcatgcctgtggtcccagctactcgggaggctgaggcaggaggattagttgaacccaggaggtggaggctacagtgagctgaaattgattgcatcactgtactccagcctgggcgacagagtgagagcctgtctcaaaaaaaaaacaaagcacagtaggatgcaagggagtaagtggtgagtgatttatgatagggataatcctgaatccactggaattccctgctcctctcctctcctcccctcccctcccttcctccattccttccttccttccttccactggaattccctccctccctcctcccttccttccttcctttttatttctttctctctttctctctttatttactttctttttctttcctttcctttctctctctctttttttttttttgtgagacagggtgttgctctgtcacccagcctgcagtagtgcagtggctcgatcagggttcaccgcagcctcaacttcccaggctcaagtaatcttcccactttaggccacccaccgaccaagtagctgagactacaggtgtgcgccacagcaccagttaattttttcttttttgagatggagttttgctctggttgcccaggctggagtgcaaaggcgagatctcagctcactgcaacctctgcctcctgggttcaagcgattctcctgcctcagcctcctgagtagctgggattacaggcatgcgccaccatgcctggctaattttgtctttttactagagacggggtttctccatgttggtcaggctggtctcgaactcttgatctgaggtgatccacctgccttggcccccgaaagtgttggaattacaggcgttagccaccgcgcccggccactagttaattttttttaaatttcagtagagatgaggtctcactatgttgttcagcctcgaattttgtttctcaaagtgaaacacaattatgagtaataaaggacccagaatcccttcacagccataacagcatgcttgacaactgctgctgcctagcttgggggtttccagccttgaggttgagcctaccctaggcttagcaggaggccagagctgagctgagaacagagcccaggatgattatcactcctaatccatgaggtaccaagatgtggttctgtgtgacaccttgagatggctgagtactctcagtccctatttattcttagcaaagcaaaccacaagcctgcaagctgcttgatgacttagggcatcagtgttcagaaggtctctatggggactgatgtcctgaggtgactagacgcttccagacatcagtgcccgtggcacccagatgacacttctcgcgaggctcccgtttttctgcagactaggctgtctcttcataacagagcctagtttccatcaaaatgccctgacttctcgagaggacaagtgctaatcttttttattttttccatgcccacggccggtcagagaagacctatctctacctaccatgctccagatagccttacccttgagccagatttgtctaagatggtgatggtgataacaaacacatctcgggtgtactgatggacaggaagtcaggagagacaatgacttgctgccctgctatgctaatttgttggccaattcataggaggtggcagctgaagttgtaatgataacttagagggcagtggcagcaggaaagttttctaaaaatggcttttattacaaggctttcctgagtttggctatacccaggcattatgtcattaggaaaaactgatgacactcaatagagaaaaagaaatctgttcctaaagcggaggctttctgaaagctattagctgtctccttgaaatcacaacattgaagatttcacagcaacagcaacacattgtaaggaagcattaggagatgtttgcatctctgccttctttattactcatttctctagtaggagaaagtgggggaggagaggaaagatggcaaggttttttattattattattcattcacacttaataaagcaaagcataacgctgatttttttttttttttttttttttttgagatggagtctcactctgtcgcccaggctggagtgcaatggcgtaatcttggctcactgcaacctctgccttagcctccagagtagctgggattataggcgcacaccaccacgcctggctaatttttgtattttttagtagagacggggttttgccatgttggccaggttggtctcaaactcccgacctcaggtgatctacccgcctcggcctccaaaagtgctaggattacaggcgtgagacaccatgcccagccaaccctgatatttaaaaataacatatctcggttgcagtgagccgagattgtgccactgtactctagcctgggcaatggaatgagatcctgtcttaaaaaaaaaaaaaaaaagtaaaagaaaaaaagagttgactacactaagatggatggtgaagatgttttgctgctatttggtaaaataataataataataaaggggtcagcgtggtggctcacacttgtaatcccagtactttgggaggctgaggcaggaggatcgcttgagcccaggggttcaagaccagcctgagcaacatagcaagaccccgtctctacaaaacattaaaacattagccaggtgtggtgagtgcacctgtaatcccagctacttgggaggctaaggcgggaggatcccttgagcccaggagttcaaggctgcagtgagttgtgatcacaccactgcactccagcctgggcaacagagcaagaccctgtctctaaagcacattaaaataatgataatcatcataaaaagcaaatggtcaggaaattgctcccactcacgttcatggttccattgatctctgccaccgactcatcatctgtaggaaactgatagatctggactccgttgctgacaagctcgctggtgattttgattttgaactttgttagctcactcttcgaaatggcatctgctttggcaatgatggggatgatgttcacctagggagaggaggggcaaagtggggtcattgttggtaacctgcaactgatagcagcatgacctaggacttccaccagctgccagagggagccgctcagcccagtggtcaaagactggccacttctgtagccaaatgacaatataataaacgacaagtactaactatgtgctgggcactgaactaagtgctttacatgaattagcacaattaatcctgacaataacccttccaggaggtattattactactattttgccaatgagaaattaaggcatagggaggttaagtaacttgtccaaggccatggagcaggtaagtaggagaactgggattcaaatccaaactcagccttattcctaagtccatagtcttaagcatgagctgtctaccagttcagatccaagttgatgagctgtatgttatcttggtatcaaggttactgcttgggagacttgaagcagaaaggtgatagctgggaatctgtggctgacaggggagaggtggcctcttcttgctaagagtaaattgtcccaacccatcgggtctagtctagcccaagccgggtgtgatatggacccacatgagagatggcagggaaaggaggcagggacagtgctcagtgaggatgcacacctggctctctttctggcaggagacactgaataatcaactcagttaggtgaggaagaacctatagttacaatttgatctgagacttatgcaaaaagaattatactgcctgagtctcatgattaatttctgagtaagaaaagcaagtataaatgcccaatttcaggcatcaggagaaagaactaatcccaaccaaaagttcaatccacctgaaccctaatccttgaaattcctccaagaagggacaaggcttttactgtcagaaggtaaagaaacttgaaatgcacatgtgtttgtgagacagagcacactaagttcaggttgacatggagagcataatcattcctgccagtagactccaacggggggtgggggaggggcataggtggcactcaggccccggactctaaaaggggagtctgggagctccagacgtggaagaaaaatcctgcttcctctgcgctttggcttaggagtgcctctgaaggctgatatcacacagccgctgggtcaaggaaagactgaaccgtggaggcacctcccttgaagtctttcaggggcagaagggtcaaagcccttgccaagatgaaacagcaggcagagcctattctccttggcactttcgccaagtccccattgacacactataaacatatatcaggccaggggcagtggctcatgctgctaatccaagcactttgggaggccaaggtgggcagatcacctgaggttgcgagttcgagaccagcttggccaacatggtgaaaccccgtctctactaaaaataaaaagtatccaggcatggtagtgcatgcctataatcccagctactcgggaggctgaggcaggagaattgcttgaacccaggaggcggaggttgcggtgagccaagatcgtgccattgcactccagtctgggcaacaagagtgaaagtccgtctcaaaaataaataaataaataaatatatatgtatctatctatctcaaaggcttaactcggcccatccaccaggcctgcagccatgtggctcaccaatgcccctatacaggacatgcagggcatggccacatttcaagagcagccttttattcatgggccatgagcctattgctgcaaaaaatgaaaaactgctcctattctgatgagagctgaaattcagtcttagagtggatgtgctactaaatggctgcatgtgaattcgattatttttttgatacggagtctggctgtgtcgcccaggctggagtgcagtggaatgattccagctcactgcaacctccgcttccaggttcaagcgattctcctgcttgagcctccccaatagctgggattataaatgcgcaccaccatgcccagttaatttttgtatttttagtagagacgggatttcgccatgttggccaggctggtctcgaactcctgacctcagatgacccgcctatcttggcctcccaaagtgctgggattacaggtgtgagccaccgcacccagccaagtttttcttaaaggaagacaacgcctgattcccacagccatctttctcgggcatggaagcattataacatggggtcacagatctgagtgtcacagaatctgcactctaccagtagctagcaatatgacaatgagcaagtcacttaacctctgagagcctcagttttctcttctgtaaaatgaagataacaataatgtgtacttcacggggctggcatataatgagggttttaatgttaactgcaatcataaaagtaattattgatagcaagaataactttcaaagtcaagtttgcatgtttgattctagccagttaacattcggacaaagaaaaaaacagctttccattgccaaagcctttgcccctagacccagggagccatcttgctagtccccaagagggatcagggcagaaagacagctcagggcaagcccatccctagtgctgggaaaacagatcacaaagcttacgacgctggtgctggatccgtaacaccatctttatggagggacagggaatgagggagaggatgaggatgccacaaatctctcccggaatcccacatctactttgcacaagagatcagtaagagtgagcccccagcgcccccgcccctgcctcctataccttactgtccagcttcttcatagtcactaggtccagagacttcagggaatgacccgtgggggcaatgaaatacaagcagacatggattcgggagtcatggtaggtgtgtagcactcttcggatctttagctcttcctgcaggtaggcctcgaattgtgcatcgatgaattccacgataggcttgtagctaaaagggagagcagggacagaggcggatcccgtcaaaaacttggattttgacaccgtcctttttggaagtttcaaatgccctctgtaatcttgactctctcccatccaactgcatttctccatctcccttcagtgggcctccaatcttgtcagcctggccaccttcttggtccctacatgagccaaacttatgcccatctgtgcaccttcactagaatgcccctttctctctcctcatcccaattctgccctcccagacctcagggctcagcttaatgtcctcctccttcctacggccttccccacttatgccagaaatcccttctgcgagtcaggggcataacaagaaatggcattcaattacttattgttgcttcacaaggattctctcaaatagattgtgccttcctaaagagcagggcctgtgaagggcacttgtctgtccctcggggggccccaacacagcatggagcccactggctgtatctgtagagggactgattttcctccaagctgggctcatgtctttgctccctttatctcgccctacagtgcctagatgagagctgggtacacagtgggtaacaagacctctctttggcccactgctgggcaatcttgtgagaacattcagggcttttgctcattctcgctaggtttagcggagctccacacttggctcccccaaggtcaagatatttttctgattctcatttctgccaaggtggtgactttaagtattcaggccaggcacagtggatcatggctcgtaatcccagcactttgggaggctgagacgggcggatcttctgagctcaggattcgagaccagcctgggcaacacggcaaaacttcgtctctactaaaaatacaaaaattagccagctgtggtagctcatgcctgtaatcccagctactcaggaggctgaggcaggagaatcgcttgaacccggaaggcagaggttgcagtgagtggagatcatgccactgcactccagcctgggcaacagagtgagaccccatctccaaaaacaaacaaacaaacaaacaaagtattcaggcaaaatctggtaaagctactcccctccgcacaccctgcacacatggacacaggcccgccagctcactgagtctccacacgcggctcctctaggtggcccccaagtcttgccaaggcttcttaaacaacagtcagccctctatgtctctctttcctgggcctccctgggaaacttccctctccctctgtcccagtcccctcccacgtcatccccgtcacccctacggcctctttctgctctaactaggtcagcttagctcagctctgcctcttgttctcatctcccctgtctgtctgctgcctctctggctgagggggtgcctcccttcaggctagaagaggcttgtcatgtgggcccagggcagggagttttcagataccgctgccagaagggaacatgatgatcaaaggaggagctgagcccagccaatgcctcccacctgcagcagctcccaggctgagcctttctgaaagatccccctagtagagaaggggaaaatagccttttaagaaagaatcacaggatcctagattctgagagctgcagccagagctgagatccaggtgcaggctatctctggagccccagagaaaaatctttttttttaagatggagtttcgctctgttgcccgggcaggagtgcagtggtgcgatctccactcactgcaacctctgcctcccaagccccagagaaaactctaaaaacatagtcctttctttattcctttgatccctccgagccactgttccgaagggtaatcgcatcaaagaatctcttggttgcaaagatccttagaaggttcctgacgaatttggagtgagggtggggaatgtatcccctaggcttatttaattaatttttggatgttttgctgatttgaaatagttgatgatggcactgcttcattttttttctcaattacgtaatttttttttacttcattttttgctttgcagaaggaatcagaggaaagaaaataaagctaaaaagtgcattttttagctcccccacacaccccgaaatctgtagtgataccctgtgcctgtcttactgcaattgcctctggctctcggaagctctcaagatgtacatggatcagaccagccaaaccagccaatcagccaccaggatttggtgtagacgaatcctaaatgggtggcttatcttcgtcttattcatctctgtatcctccacgtctagcctgctgtctggaacatagtaaagtttccgctactgctctgcattccctccacccccaggccccagtgactcatcttcccacggtggccacctctctcccacactctgttgtgctgctcactggactccagtgggtggtaaacaaaatcctttactcttataggctacctcctcccaaactgcttccttcctctaagtgacacctgactatccttcagagatgctgcttttctcatatccttctcaactggaaatttcttcatctccacacccaagtcccatggaagggcagagagggcagctttcttctagctcttgattccctcgctcactgtgatctcctcatctcctccattttcgaccaaaaccagctccaacagactccatccctccccatcactactgataatctttgacatttcaagacagccgttcttaacacagggttcatggacctcctaggttctgtgaatagaattcagaggatctgtgaacttagataggaaaaaaatacatctttttcactaatctctaactgaagtttagcagtttcttcagctgcagacataggtaacaatctatagtaatgttagcagtacctgtgatttcataaccaatagaaatcactgatatcatcatttcccattccagttgttgtaaatagctcaaaatagcatttatactcattacaacattcaaattctggtaattattaagcctgcatatagatattattacttctggaattgatagagaagcacatggattgctaagtcacaatttttaaatattttagtaactgtatttttagtatacttggtatattttaggcatttaaaaacattattttgagaatgagcccataggcctcactagattgctaacggggccaatggcacaaaataacccctggtctagacaataatacttattcatttcggataatgatatgtactatgaagatactccaataggataatgggatatacatgtgattgagggttcaactactttaaatacagtgatcagggaaggcttctctaagggtgtgacatttgagccgcaaggatgaggatgacagagccatggagagatctgggtgaagagcattccaggcagtgggaataataaatgtgaggatggttctgaggcagaaaccagtctgacaggtttgagcaatgggaagacggccagggaggtgggacttggtgaacccagcttgagtaaattattcacagtagcccaaaggtggaaacaaccca[134 bp omitted]cagggtgaaaccccgtctctactaaaaatataataattagctgggcatggtggcgtgcgcctgtaatcccagctactcagaaggctgaggcaggagaattgcttgaaccgaggaggcggaggttgcggtgagccaagattgaggcactgcactccagcctgggcgacagagtgagactccgtctcaaaaaataattaaataaataaaataaaataaagaaaatgtgaaaatgtggaggccaggtggggtggctcacacccataatctcagcactttgggaggccgag[132 bp omitted]gaggcaggagaattgcttgaacctgggaggcggaggttgcagtgagccgagatcgcaccactgcactccagcctgggcaacggagtgagattccgtctcaaaaaaaaaaaaaacaaaacaaaaaaactgtgccttatttcttagtatctctgacacttcacactgtacttgtcacatagtagacatttaagtttataaagtggactaggtttccacggcaacttggttctcagtcttgtcaattctctcaaatctgcccctcctctctatcctcaaagcttctcttcctgttcaagccctcatcatctctcccatcctcaagagttgcccctgacctccttgtccccctctagacatggccttgtgtatttctcccagctcagacaagctttcttttttatctattttttagagacgaggcctcgctctattgcccatgctggagaacaatggcatgatcatagctcactgtgacctcgaactcatgagctcaagcgattctcctgcctcagccttctgagtatctgggactacaggcacacaccaccacacctggctaattttttatttttgtgtagagacggggtctctttatgttatccaggctggtcctgaacttttgggctcaagtgatccttctaccttggccccacaaagtgttgggattagaggtaagagc[229 bp omitted]gaggcaggagaatggcgtgaacccgggaggcggagcttgcagtaagccgagatagcgccactgcactcccgtctgggcaacagtgcgaaagtccgtctcaaaaaaataaaaaagaataccgattcttccttcctcacagataacctctattttcagtttgctgattatctttccagacctttttctatgcatctacgcacataaatagagagaaatatttgtggttttattggagggaggggggcagatttacagacaccgcatcgtgatcattctgcaacttctttttttcacttaacaacatatcctgagatctagccatgtgagtatatatcgatctacctcattctattaaactgccaaacacaattccatggtatggtaattccacagtttatttaattgctctgttggtagaaatttagactgtttaaattgtttttcattcaataaccaaagctacagtgaacatgctttctctatgcttctcaggagcatgtgcaactgtttctctaggctgtatacttaaaaggtggaactgctgggtcataaattattcacatttaaaattttaatagatactgccaaatttgccctccaagaagtctatatcaatttacagtcccatcaacgtgaatgaaattacctcgtgttagtggatattataccatccttttgtttttgcagatctgatggataaaaaatatttgtttcattttgcatttctttaattactggggaagttgaatgaccatcatttcatatgttgattgtacataagtatttccccttctgtaaattatttgtttatttctcattgaattgtagaagctctttttccattttagaagaatcctttgtctgttatttaggcagcaaatatcttctccccatctgtagcttgtttgtacttttgtttatggtatctttcaatacaaaagggttttttattttaatgaatttaaatccatcagtcttttcttctatgacttttgaattttgtgtcatgattggaaaagccttctctacccccaaagttataaaaatattctctgatgttttctccttatatttttagaaatctgtttttagtccaatgggaatctatttttgtgaatggtgtttgtgtgagagggtctcgttttatttttttcctaaatagatggcctattttcccagcatcatctcctgaatagtccattcttcccctgctgacttacatatgctaaatttccatatgagcaggaatctggtcttagactgacttttctgttccattgctctttttgctcttctgatgcctttacatgcttactttccattcactcagcaatcacggtaatctggcttccacccacagttcccctcgaattattattctgaaatgtattactgaccttcatatcaccaaacccaaagaatattttgcagttctcgtcttcctggataccatgtatcattccttcccatatactacatgatttagctgttccttgattcttctatcaataaaaatcatgatcataatatcttcagtttatgaggcagttactctgtgccaggtgtttaagcatttcatattccacacatgtcaaatgtgcttcaccacaactctctaaggtaggtagtattattattatcatccatcattatcatccccattttacagatgagaaaactgaggcatagaaaatttaagtaccttgttcaagatccctgggctaaaaagacagcaagatgaaatttgaacccaggtctgagaccaaagcctaggttcctaagcactcccctctccagcttgtccttctcagtctctcccttaaatccccttttctccagcatccttttttatttttattttttgagatggagtctcactctgttgtctaggctggagtgccatggcgcgatctcagctcactgcaaccgccaccttccgggttcaagcaattcttgtgcctcagcctcccgagtagctgggattacaggcacataccaccatgcccagctaattttttgtatttttagtagagacgggggtttcaccatgttggccaggctggtcttgaactcctggcctcaagtgatccacccaccttggccttccaaagtgctggaattacaggcttcagccactgtgccctgcctccagcatcctttaaatggtagctttccgcagtatccggccttagtcattcctcttcctagtttatgcatgagcccttgtaaagcgggatattctaatgccttgtttcaatgatgcttcactgacatatctatgctaacatggccctaacagcatgaagaaaacactgctttttattacagatccctggagcttactccacccctgctcctcagtgcaatttcaaggaggcttttcatttctacttatttgatttattataagtatgtatcacatttataatcgggaagaaacaatagggatatcttaaaactataacggaagtagatttgcctctgaggcgcagtatctgttcagtcctcccaagccattattatcaaggcattgtccaatgttagatatgttgaatgtatgtaactgaaagaactgtaagaaatgtaattgaagtttctgagcaatctgcagctgagattaagcactcatattgtggcccaaatatcctttctccaaagtttaatttattctcaaccaaacaagattagcacaataagcatgcctataaaaagcagaggtggccaggcacagtggctcatgcctgtaatcccagcaatttaggaagccaaggcgggggtgagcgggggggatcacttgaggtcaggagttcgagaccagcctggtcaacatggtgaaaccccatctctactaaaaatacagaaaaattagcagggtgtggtggtgcgtgactaattccacctactctcgggaggctgaggcaggagaatcacttgaacccaggaggcggaggttgtagtgagctgagattgtgccactgcacttcagcctgggtgacagagtgtgactccatctcaaaaaaaaaaaaaaaaaaaaaaaaaaagcagagatgtcttttttctagaatttcaaatgcaaaacagaactcagttccattattaagaagctatatatatttggctgggcacggtggctcacacctgtaatcctagcactttgggaggtcaaggagggtggattatgaggtcaggagattgagaccaacatggctaacacagtgaaaccccatctctactaaaaatacaaaaaaaaaaaattagctgggtgtggtggcacgagcctgtagtcccagctactcgggaggctgaggcaggagaatggcgtgaacccaggaggcggagcttgcagtgagctgagatcacaccactgcgctccagcctgggcaacagagcgagactccgtctcaaaaaaaataaaataaaataaaaagaagctacatatatttattcattataaggaagtgagtgtggctgttgtagctttaagggggaaataaaagaatttgacataaagttcacctaagaagcaagagaatcctgaaagaatgagaagaccctctgcttaaaatgatgaatggccctttctgaaatgagcacatgtgataaccatgtgacttctggttaaatgcagatggtacctgaccccacccctcatcacattcccatctctgagcctcacctagtcttcactcacacacattctcaaccccctacatctttctgttttgttttgagacagagtcttgctctgccgcccaggctggagtacagtggcgcaatctcagctcactgcaaccctgcctcccggattcaagtgattctcccgcctc[223 bp omitted]attcctgttcagtcccttttcaggatgtcttttcctccatctattgacttagcatcctgaggtttttgtctttagcccagtgttcttcttactctactctgatccctgggtgattttacatgtgtccatggttggaacatatcacctctaccttgataacccaatctatttctagcctcttctcatctccaattctgtgtgttcaactgcctactgctgaaggtcatcgcgtatctcagtattcctcagacagatcaaacttgacatgtccaaaacagagctgattattttgaaccctggttctcttacggaatgccatcaccatgtgtccactctccaaagctggaaatttgggcctcattctagatttttcttttgccttcacaaccccacaccaagtgcctaccaagtcctgttgatatttacctactcagtatttagcaaatctgtctcctcttccctatctcagcacctattttacctcttgccttgatcataaatccttctgtgatctggcacctgcttacctcttcagcctcatctcaccgttttttccccaagcttactccaagtgttagcccaggggcagaaccaggtttttccagcccttaggcttatgcaatctgaaagactctctgaggaaaataatacgacattgtgattgaacattagttacagagctttggaaggggcctgtgcaatcttcattagcttcacagtgactctgcctctgtctagccaaagagagcaagctacacttccctagaacataccagaatcctacacatcactttgcctttatacaggcagttacttctgcctgagatgcccctctctccattcccttgtctgtctggcaaaacagttcgtccttcaagagtcagctcaggaggcacatcctttgtgaaggcttccctgacctccctacgtggaattgatggttctcgcctttgtgttctcattgtaacttgtcctttatctctttgtaccctgtcctttacagaacatcttatactctatggaaattatttgcttaaaaccggttttgcctatgagtccctcaagggcagagactaagccattcctttttagatggtcagagctcgacagtacctggcgcaaggtaggagctcaataaatgtttgctgcatggaattgagacctgacccatgtatactagaaagacacccttcttttggcaaagtgagtggagtggaacagttgctgtagacagggacaccagacagggcctatgcttgggaggtacctgctgctgcccacaccattctgggaggacaggcttgggcccgatatctgtgctgtcttcaagatctctgtggtgagctcctctctgcggccctctaccaacctccccaccctaccccaccccaccgccttctttacctgtcctctttgttgatctggtccccaaagccaactgtgctaacgatcgtgagctttagcctcacgttgctctcttggaggtcataggtattagactggagctggacacccggctgtgtgtgggtggctggctccccttcgaatttggtgttgaacagggtgtccatgagggtggacttgcccaaacctgtctctcctgaaaagcaaaaggataaattatggtctgttcacatagtgactattcagcccttacacatcatgtttcatatacacatttgttgacacgggaaaatgaacatgataaaacataaagcaaaaagcagaagcagatgaactatatgatgtcagttaaatgaaaaagactgaaaggaactatacagacggatcagtagtagtcatctcagatagtagaattgaggtaattttcattttattcttccaacttttttctgtcatttggaaattttaccttgagtatacattgttttttttgttgttgtttgtttgtttgtttgtttttgagacagagtcttgctctgtcacccaggttagagtgcagtggcatgacctcggctcactgcaacctccatctcccgggttcaagcgattctcctacctcagcctcccgagtagctgggattacaggcacccgccaccgtgcccagctaatttttgtatttttagtag[138 bp omitted]aaaaagaaattatgttataggcagcaatggagagatatagctatgcctagaaaaaaagactgggaggaaatacaatatactcttaccaatggctatctctgagtggtgatcttatgtgtggttttcatccctttctttatgcttttttatatttcccaagttttctaagtggaatatgtatagtttttgtcataaaaattagaggactattttaaatttttttaaaaaatgacagcagtggccaggcgtggtggctcacacctgtaatcctagcactttgggaggctgaagcaggcagatcacttgaggtcaggcattcgagaccagcctggccaacattgtgaaaccctgtctctaccaaaaaatatatatatacatacacaatttagccaggcatggtggcaggcgcctgtaatcccagctacggaaaggctgaggcaggagaattacttgaaccaggggaggcagaggttgcagtgagctgagatcgtgccactgcactccaccctgggcaagagagtgagactccatctcaaaaaaaaaaaaaaaaaaaaagacagcggtcccttgtcaaacaaatatcctttcatcccagtccccacctctcctccctgccaggcctaaacagccctctggggatgccccagatgtgcctccccacggtgaaaactgtgcaggctcctggcttatcctcccagcctggttgaacggttgaactttcagtgagaccgtttttaactaagaggggcggggtggggagacccagcaggccacaaaaattcttcttcttcttcttcttttttttttttttttttgatacagcgtctcgctctgttgcccaggctggagagcagtggcgcaatctcggctcactgcagcctctgcctcccgggttcaagtgattctcctgcctcagtctcccaggtagctgggattacaggtgcctgccaccatgccctgctaatttttgtattttcagtagagatggggtttcaccatgttggctaggctggcctcaaactcctgacctctggtgatccacctgcctcggcctcccgaagtactgggattacaggcatgagccaccgtgcccggcccttatccttaaattttaaacaaactagccatttatttgtttaactactaggctgcgagatactaataagtcaaactgttggaattttaaaagtcttgaacttcacactagggaaaccagtaggggaaaggctgtggcagactggtgaaggttttggaagcttattcctgggagatcaagggataccaagccactgtcaggagccaacaagacttcagggaatgggacatcacaagaagtcaggagttggtgacaagggggctaaacaggaatctgatatgaggccacaaactgggctgggcgctgcttataatctctacagatccaggctgtatttgacccctcagcccacccc[187 bp omitted]gatggtgggtgcctgtagtcccagctacttgggaggc[136 bp omitted]ttcgaagagaggatatcattaattactctggcctgccctttgaagacaaagactactctcccatttattccgctatcatcatccctgtttttccctctcctctccccaacccagggggaatgtgagcctcgacttctcttcacagtcgggactgggtttgcattgggcaaattgtggcctgccaaaccccgccttgcgaccaaaagcacacatctgcagggtggttcagggctacggttagagctacatgatgcagaactgaaaatgctccatctcccctccccactctgggtgtgtctagcctgcttcttttatcccaaataatgagctatgaatgcaggaggtgccttttaaaatatctgtgtatgatgagagttttctgtgtgtggacagagagaagggagagagagagaagagataagagagaggagggagacagggagagggagggagaacaaggagaacattcaattcagtctggctacccggccccccagcccaatttcatagccaggtctgactaacttggtaaattgccagagtgtggggaaatggttcctcacacagatcatgtttcaagccagggtctgctatatccattagcagcaaagactcttgaagaagaggccccctttttcctcccctaaaggaacaggaagtatttgggtcccaagaagaattttatgaggtggggcctttgccatgggaggtggcagacttggccaagcagtggaatgtatcacaccccacctcacccaaagttggggtgcaccttaactgcaaacggggccagcaccttggaggtgggaacacagtgtggctcccacatcctaactcacctcccctctcgagggcactgaggtttgagctacagtttagctcatcttcctatgtgcctgatgaattttccatgtacatccttacccccaactccctcccatggaacagaagggagcacatggaacagaaccatccttacccccaactcccaaaacccttctgttgcatgagctccctgccgaatgccctgtagctcctagggagtgggggtcctgtttccccagcacccagagtgggcaccctggctccccgatcctaagaattctcagagagcaggagatgggccatcttccagtacccccgagagtgcctaacccaaggttcacacagaaggcctcaggggcagcaccgcagcgttgagggacccaccctgtttgcacagctggaggaatgggggccgggcagggcaggacagggagctgggaggaacagcaggagaaatgaccacccaaatgcctgctggcacaaaagcgctgtggaaattagatgccaaataatgaacgtctggaagaaaagaacacccgggtgtctagggaattgagataaatgcaatagtagagagggcagaaaatcaagcgagctcatcctatggctatcgagagctcctgttccagttttccatcagtgtagagcctgggggtcggggaggctttctgtcaatgactggcacagacccagcctgatcctaggatgctgcccctcccacggctgccctgggcccagtactgagtgtgagtgtgttgtgagggggaggcacacgtgacctaactgggatcaggtcagcagattccacacccctgcaggaaggtggagacttggcaattcgattccagcaggaaacctgaggagtcccgaggggtcaatttctcactcctcctcccccagccctcccagggctcctccaagtggatagtaaggtttttaacgcatgctccaccagccaagaggatttcatctcactttgcttaatgtagatagtattctggaaacaatagttttaaaaaaaattaaaacatatatgagtactacgaaatatgttttttttcaaactatgctcttgcgggacggtggctcaggcctgtaatcccagcactttgggaggtcgaggcgggtagatcacctgaggtcaggagttggagaccagcctggctaacatggtgaaatcccgtctctactaaaaatacaaaaattagccgtgcatggtggcaggctcctgtaatcccagctactcaggaggctgagggtggagaatcgtttgaacccgggaggcggaggttgcagtgagcagagatctcaccaccacactccagcctgggcgacagagcgagatcctgtctaagaaagaaaggaaagacagagagagagagagagagagacagagagagagacagagaaagaaaaagaaaagacttctagccaggttatcactaagttactttgtgacatgaactgagctctttcccctctctgggtcccagtctctttttctataaaatgagagcgttggtaataacagctattgtttacagacactgctctaagttttttacatatattttcttatttattcctcacagcaagcccatgaggaagatgttactatttgtcctcaatttatagatgggttaaccaagccacttactagctgtgtaaatttgcaccagttcctcagcatctctgcaccttactttcctcatctataaaatgtggaggggccgggcgcagtggctcatgcctgtaatcccagcactttgggaggttgaagcaggaggatcagttgaggccaggaattcgagaccagcctgaccaacatagaccctgtctctgttttattttttatttccataggtttttggggacaggtggtatttggttatatgagtaagttctttagtggtgatttgtgagattttgatgcacccatctcctgagcagtatacactgaacccaatttgtagtcttttattcctcacccccttcccgccctttccccctgagtccccaaagtccattgtgttattcttatgcctttgcatccttatagcttggctcccacttatgagtgagaacatacaatgttcggttttccattcctgagttacttcacttagcataataggtctattttgaaaactagtaataataaaataaaatgtggaagaagtaactagtccaaggtcacaaactagtaagtggcagagccagcatttgaatccaggcaggccgacgctggagtccatgcttttaaccaatgtgctctagcgagacgcataggcgtgatacgtttgttcattcagtcattcaacgagtatttacaaagactctaacaggagccaggcacagttataggagctgcagatacagcaatgaacaagatagccacaatccctgttcttgtggacctaaagtctcttccagttctgaatgttgaacccagagaaacgtctctgagttcaacagggaggtgcccaaaaggaaacattccaggaactccggttggctaaggaagcctatggaaagggacaaggttatgcctggctctgtgaccttgtcctttctccttcctgatcttgcagaggcctggcaggcagtggtgtgctggagccggctcgtccgcttcctgcatctcttcccaagcccacgtgcagtgatgtcatgttggtagcttaacagcagccatggcaggagtaatgacaccaacaaaatcagcagatgcttcaaaccacaacagtttttctcctgagatgggctgtgacgttgaccagcacaccactgctggcagcctgttttagacaaataagcagctgcctttcccagatatgaagggatgaaacaattgatccttggccttgatagaatgctagctgccctttccctcctcctgcagcaagcctcaatcctgcttctcttgtgtgactgtttttttccatgttcaacagagcccaattgagcctggaatcctgagcagcttcaaagtaaatattatcattatgaccctttgtgctcttcacagccatgactgctactgtagcatttagatggatgagtctctttggggcttgttcccaggagtgcaaagcaacgggccccagaatatttgtactgttggctctggtggttcctctgaggcattctgtactgcatctaggatcaggggatccttgaaatttccaaagctaagggactagtatatgtgtttttatggggagaaagaggaacctcacctcttcggtaattatggtcaaccctagagaatatattggagaggagtcataatatgttcacactcatgtgcctagtcctctaaaaagaataataggccaggtgtggtggctcatgcctataatcccagcattttgggaggtccaggtgggcggatcacttgaggtcaagagttcgagaccagcctggccaacatggtgagaccctgtctctactaaaaatacaaaataaatcagctgggcatggtggtgcgcacctgtgatcccaagtactagggaggctgaagcatgagaatcacttgaacctgggagatggagg[132 bp omitted]ttaggttctggattatcaaaaattctcggccggacgcagtggctcacacctacaatcccagcattttgggaggccgaggcaggcagatcacctgaggttgggagtttgagaccagcctgaccaacatggagaaaccccgtctctactaaaaatacaaaattagctgggtgtggtggtgcacgcccataatctcagctactcaggaggctgaggcaggagaattgcttgaacccgggaggtggaggttttggtgcgccaagatcgtgccatcgcactccagcctgggtgacaagagcgaaactccatctcaaaaaaaaaaaaaaatgctctctcttagttgcaacacacatatgtgcacagatgtacacacatgcacacatgcatgtaggataccttgctggatgtaggcctatgatcggcagcccagcaccaagataaacaatagtgtgaaaaaatatcctaggtctttgttaataattgaagctagtgctaccataattttacaccaaaaatgccctatcaagaaaaagaaacgtttgggtatggtggctcatgcccataattccaggactttgggaggccaagtagggaggactgcttgagcccaggagttagggaccagcctgggcaacatagtgagacctcatctctacacaataagtttttttttttttttgagacggaatctcactctgtcacccaggctggagtgcagtggcgtgacctccgctcactgtaagctccgcctcccgggttcacgccattctcctgcctca[224 bp omitted]ggtggcatgtgcctgtagtcccagctactcaggaggctgaggtgggaggattgcttgagcctgggaggttgaggctgcagtaagctgtgatcacgccacagcactccagcctgggcaatagaacaagactgtgtctcaaaagaaaagaaaagaaaatactttggggaaatatattctatgcccaaacagcatcttgttataacagtcattaagggagtaaatgtacacaggcagtaggcatgaactatcatcacaaaaagctctgcaagataaaagatcaccttcagcagctaagctatggaccctttgcgaagtcagtgactggatccagcctcatggctgggctgacattgcagcttcagagctactctaagctacttatgaccttggcccaaattgtgggttctctgagcaaggacagggtggtgagcacagcaagagggcaggatgcgtgcattgcagggttttttggaacaggggtgaaattaacccagtcggggctggcctatccaatggttgcacctgtgagtctaagacaggagctacagaggcagccatttcctgaaacttgacaagtggggagcaaaagagagtctgtgactcttgaggatgagagcatctccttcctactcctcccctcttggagggtctgtgctgggtacttgagcaattccatcccagcaggtgcaagtggaagcatttatagctgtacaatgtctaggtggaaactagaggatgggggattactatttctcccatccactttgccttgagcttggctgcctctgggccctaggggagcctgtgctccacatatcaaattaccctacacttccaccctcagagatccatttcaattcacatggcctccctcctaaagctttactagcccacccaatcgcactggttgaaaggttgcttaaggtggatctgtcatttctcttctcatctcaacttcagtacaggtcatatggagttctgggaagaatgccaagggactctgatatgtttgtgcttaaatattgtggtaatcaaatattatgtgaaataagttggccatcagccaaagattggagctcttgttagttaaacagagatttggcagtgctaacattggatgtgatagtctttgcacttgatgtcgattactgtgacttctagttattttacatttttctccaaatagcacctaatcataaccatcagttagactttcagcatttgaagaattaacagcctagatctggactctaaggccctcgatgtgtaattctgtgaagcacatattttcttttttttaatgtactgttttattcactaatgcctccaggtatatttctctccctatgaacaaggacatgcatagtagaagtcacatcttaaaaataagtttgagtataaatctgtggattgaaactgaagcacatattttcatctgataggttccaaagttgatgtgggccaggcatagtggctaatgcctgtaatctcagcactttggtaggctgaggcaagtggatcgcttgagcttaggagttcaagaacagcctgggcaacacagtgagacctcacctcatctctacgaaaaaaatgagcccggtcgcatgcctgtaatcccagctactttggaggctgaggtgggaggaatgcttgagcctgggaggttgaggctgcagtgagcctctgcactccagcctgggtgacacagggacactttgtctcaaacaacaacgacaacaaaaccaaagttggtgtgtgggagtgagccatttagctagggagtgagcctagcttgtgggaacaactgcccgtcatctgttgttctctacttgtccttgaatgtgtagcaattctcttacaaaaagtgacctggaaaagaatgctggggatagaggaaaaaaaatgataaagagcccaagaaaatgaatgaccttagtgagaaaacagaatttctaggctgggcgcggtggctcatgcctgtaatcccagaagtttgggaggccgaggtgggcggatcacttgaggtcaggaattgaaactccgtctctactaaaaatacagaaattagctgggtgtgtggcgtgcacctatagtcccaggtactcaggaggctgaggcaggagaatcgcttgaacccggaaggtggaggt[132 bp omitted]agtgtaaaatatccaatttagtagtagttcagatctactacatgaacaagttccccatacgctctatacaaaaataaaaggcaattagcaaaagtgtttgagtgtttcagccagtacaaaaacagactttattctggtatttatataatcattaaggttcagaaggtcactggaaatatgcaggtatgctttcccgtgttacagggtgaaaattatatgctatgatcatgtttgcaaatttgagatatttaagatctaagaagattctttttttttttttgagacagagtcttactctgtcgtccaggctggagtgcagtggcgcgatctgagctcactggaagctctgcctcccaggttcacgccattctcctgcctcagcct[222 bp omitted]tttgattggtgctcagtggtttccaaagtgctttcatgtgctcaagagatattgctggcagcagttagagaagcagggggaggaacaaggggtcaaccaggcctgagtcctcattatggtgccacttcttctgtgttgcctcaggtaagtcccttatcctccccaagactctgtgtctccacctgtttcatgaggatacaaatgctacttgctctgctcacttcgcagagtcctggtaatgtccaaaagagctaatgtgagaaagtgaaaagtataatgaatggttcctgtggcattcacccattcattcatttcacagatattaccgcactctacttgtgctgtgattagcaaatagagggggctaagatgcagctcccactgttgagattaaatgtctaggtagaggccgggcacagtggctcacacctgtaatcctagcactttgggaggccaagatgggtggattgcttgagctcaggagttcaagaccagcctgggcaacatagtgagacccccatctcaaaaaaaaaaaagtctaggcagagagataggtaaagggaataaaagaatgttgcatacagctgtgtggtgcctgcacccgagctcaaactaaaccaagcacagcaaaactacagaggaaacagacccaacccactgcccacagctggtgggcaggcgttttttgtcagctatcccctccctcccaattctgccctggatcctgtcttctgtagtcaaaatgaactctacagccatactgagccagccagctcccttacagaatttccactgggtctcacatagctcagtttccccccaagatatggccctatactctgatctggccaggggaaaaaagtaattacagccagctgtttacaaaaaacaggcagagagataaaagaagaggggagagacactctcgcaactaaatcagaatgacacactatttaacctaattacctgcaaagccgtatccagccattaaggatccatattctgtaatagaatttcctgctatggaaatactcacccacgcacaggatgttgaagcagaagccctggctgacggacttattcaccagctggtcaggcaagctgtcaaaccccacatgtccagccagggggacagttcggcaaccttcaccctaatttggaaggagtgagggagaaaatgaaaatgtgcttaaaagcagtctgggtctcgcttctccatccaaatgttcgctgtgcaaggaagtcacacccgcccaggcccagtgtgtcatctcttccctcagctactccctgctccaaagcaaaatggcccgtcagcttggaaatcacagattcttggggacaggcatcctctaggctcaatagtgaatgtcgccacagctccagagaaaattacagaggagcttattaggggcaggagagtggagtcaggggaggagaatgctggcaccgagattcacagactcaggttaaatctccactcagtcatttacaagctgagtaacttgctgagactgtttccttccacatctgccatctgagataatatggcatatcttagaggtgactgggagcctcagaaacgctaatacatgtaacgagcttagtatatgcagaagtattcagtaagtattacgaaaagggtttaaaaagcaattattgggccgggttcagtggctcacacctgtaatcccagcactttgggaggccaaggcgggggggatcacttgaggtcaggagttcaacaccagcctggccaacgtggcgaaaccctgtctctaccaaaaaaaacaaaaattagccaggcatggtggtgggtgcctataatcccagctacttgggagactgaggcaggagaattgcttgaacccgggaggtgtaggctgcagtgagccgagatcacgccactgcactacagcctgggcaataagagcgaaactctgtctcaaaaaaaaaaaaaaatcaattattggctggcgaaatgtctcacacctgtaatcccaacactttgggaggccaaggtgggtggatcacttgaggccaagagtttgagaccagcctgggcaacacagtgagacaacatctctacaaaaaatcaaaaattagctgggcatggtggcatgtgcctgtgtagtcccagctacttgggaggctgaggcgggaggattgcttgtgtccaggaggtagaggctgcagtgcgctatgatggcaccactgcactcccgcccaggtgagagagcaagatcctgtcttaaaaaaaaagcaattgttcctctctctctagagcattttgaggacctacaaaggcagtgtagtgtagaggttaagagtagaggctttgaaatctggcaggtgttagttacagccccatctccaccatctcctggctgtgtcaccctcagacaagttacataaacttcttaagttttccccatccataaaatcggaaactattgagtaggagtgtgaggattatacaggatcatgctcctcaagcccttagcgtagtgcctagcatgtggtgagcattcaatcagcagtagctgctgttgttattcactgtggggttatccttacacccccagcctgaagggtactgcatggaacactgtggctccctatggctacaagaagctgcctccgtgcttcctctgggtcccttgactccctaagggtcagccaagccactcccagccctggaaagcagagggcctttgcttcgcctgcaaggcccaaagctgcttatagttaatgattttacaaaacaggaggagactcaaactggaacaggattccaaggagccagggggaagcataaaaggggcctgcgtggagcgtggactcaagaaatgtgccaaataccaaccaacggccacaggggaggggaggggacaggggagaagggagcttgagacagctgagctagacaagaagggagtactatgtaaggagtcagtttctgttgggtggggctgcaccaagctttccataactagaaagatgccaagagcagtccaagaagggcacggttagtgccaggaggcccagcccagcatcacaggctgcactaagcaggcagctcttctgttgggctggaccaccttttagactaggtccataataagggcacattttcacactgaaaggggtggggtgtgagggtggtggagcctctcagcagccaactttgtcagaaccggctcccagatagccccttcacacagctttagatctcactcccatcggtgtcactagatcctgtgagggcaagcgacagggctagtgccggtgaatgccatgtggcaagttcattaccctcacacatctcaccccacaccctcccagtggagaactcttaacagacaaccatatgccatcattcagtgagagttggtgtattctctgccccagggggtcccctgaagacacctgaggctgggtgcagtggctcgcacctgcaatcgcagcacttggggaggccgaagtgggcggatctcttgagcccaggagtttgagaccagactgagcaacaatggcaaaaccccatctcaacaacaagaaaaatacaaaaatgagccgggcatggtgtcgtgagcctgtggtctcagctactcagcaggctgaggtgggaggatcacctgagcccaggaggtcgaggctgcagtgagccatgatctcgccattgcactccagcctgggtaacagagcaagacactgtctcggccgggcgcggtggctcatgcctgtaatctcagcactttgggaggcc[134 bp omitted]gaggcaggagaatggcgtgaacctgggaggctgagcttgcagtgagccgagatcgcgccactgcacccagcctgggcgacagagcgagactccgtctcaaaaaaaaaaaaataaataaagacagctgagcctcatgagtggttcacatcactcaaggctttgttctacgttcacccctttctgcttctccttctcatttccccttctctttattaaagcaaacaaagtaagatgcaagattcccactgctagttcttggtccgcaacgctgcaggggagtcagggacatgagaactgatatgctttctttacggagcctccgatgtagcaggcatcggaaattgaggtggactcagagttgaggtttcctgagccatttgttatcacccctggctgcctcttccggcctccaacaaattcagcaccatgaagcttcaagtgctccaaagtcaaaaggagaggaaatgaattttcaaactgaagacagtgctgtaaagagccctaaacggcagaagaaaaaattttcttttctttcctttttttttgataaggagtctctccctgtctcccaggctagagtgcagtggcgcgatctcagctcactgcaacttccgcctcccaggttcaagcgattctcctgcctcagcctcccgagtagctgggtgcccaccaccgcacccggctaattttttgtatattttagtagagatggggttttgccatgttggccaggctggtcttgaactactgacctcaggtgatccacccaccttggcctcccaaagtgctgggattacaggcatgagccaccatgcctggcccaaaagaaataattttttaagccctaagaagcagaagtatggacttcatttcctaagcaatgggatttgggggattttgagtgatttgagcagggagggccatgatacagggagtgtttttaaaagatcactccagctgcagggtgtttgcttgattggatggacagagagactaggagcaggaagacataggaggagatgactccaataatgttgagccagcagagtgacatccaggcactgtgacaataaatgctggttggtgtgaactgacctgacttgggactcaaagagaag[136 bp omitted]tggtgaaaccccatctctactaaaaatacaaaaattagccgggcgtggtggcgggagcctgtaatcccagccactcaggaggctgagaggcaggagaatcacttgaacccaggaggcggagtttgcagtgagccgagattgcgccactgcactccagccagcctgggggacagagagagactccgtctcaaaaataaatacattaattaattaaaaaagaagggatgagcctcaaggagtgattgggcagagagaacaatcgcaagggtctaagcccgggagcttggattgacagcaccatggagacacataggaaagccaggaaaagatgcctgtttaatggggacgatgaggagactgattttaaattagctgttactaaaaaaattacatttatcagattttttattttgtggaagtaatcaatgttcactgtagaaattttagaacatacagataataataaagaagaaaatcaaaatcaaccataatatcactctccagagataaacactcttaattttatttatttatttatttatttatttatttatttatttatttattagagatggagtttctctcttgttgtccaggctggagtgcagtggcacaatctcggcccatgggttcaagcgattctcctgcctc[212 bp omitted]ttgtatctgttacccagtgtccaatacacctaaattaactgaggagtttgggaaagaagggacatagaacctggtcaatgtgtttttcttgctaactgggatttaagcagcaaactttttgtctc[219 bp omitted]gagttaggagaatcacctgaacccgggaggcagaggttgcattgagccgagatcacgccactgcactccaggctgggcgacagagtaagactctgtctcaaaaaaaaaaaaaaaatgtatttgtatagttcctactttaggaaatcctgtctggcaaacactatgcacccttgctttgatgaatcttataagatgtcaaggtcatcattatgagtatcagtccgcattgttcagagttaaatacgcaaaggtaggaaggacagaaggacacaacattgaactgaatgtacactgaccccagcacagcccctggaagtttctcccctcctctctcactaaatctctgatatcttatctctttcctctttctccttaaggtggcctgattaattgagggcctgattactttgattgcagttaattgaatgttccttgactacaatgtgcacgagaggagatggaaccggcaacttggcccagcatgtctgacagtaaatctcaagttttcatctttagtagcaggtggtgccatattaccatactgaaggcctgaactgagatgctggaatggccaaagtcaccattttaaattgcacttctctcataaccctgcaacctcctctcagaatctgtacaaagatctattacaaggaaatttattacagcacagtttataatgctgaaaaaaaaaacccaacctaaatgtccaacaataggaaaatatttaaccaaattatggtacacgcatattctggaatattctacatccattaagaagcatgtgggtagttctgtatgtactgatgtgagtatctccaagacatattataaaacagaaaacagaagttatagggcgactgtaataaaatagaagaaaatggaagttattacatgactgtaatcccagcattttgggaggtcgaggcaggtggctcgcttgagcccaggagtttgagaccaacctgggcaacacagcagaatcccgtctctacaaaaaatacaaaaattagccaagtgtgttagcacacacctgtagtcccagctacccaggaggctgatgtgggaggattgcttgagcccggtaggtcgaggatgtagtgggccaagattgtgccactgcactccagcctgggcaacagtgagaccctgtctcaaaaaaaagaaagaaaaaaaaaagaaaatagaagttgtaaactataagcacaatatgagcccatatatgccccagaagccctgtagatgtgtatttgcacgtaaatgtatgtggatgcatagaaagaagactgaaaatacagccaccaaacccacaatcgtagctacctcaggggagggggatggaaataggggctcagtcaagggagtagtcggtatgcttccctattgtttgactcttttatagcacgaatgtattcgcatgttacccatgtaattttaaaacatttttaatataagaaagaagagttctcactcagctttgcagcaggggtaattaggatgcagagagtctgagaggagctaaaaggaaggcaaaatgaaagagtgctcctgagaactgggagagcgccccactcccctccccaattacatttcctgttttctcctcatctgcagtcacctgtggtttttaaatacgttataccacatttcatatcacaggcagaaacactgctctctttctcttctgcctcctctcctgaggacacaccaatttcgttttttaattgaatattcgtaaggttcatattatcaagaacaagttatggtggttccagctgcgcatctttctctcattgctgttactgaaaataaagagtcccttaagcacccgagtaggccacctctgtcccccactccccttggcccctcttccaacctctgtgatagtaagcaagccgtatttgaggcctctgggaactgagggtgcatctgtgtcaatggagaatttcccgcctctgtttcaaaccagggtggctaaattagtagctgtcattctaaagaataaaagcaaaaagtttgaaactcattgctgatgactaggctgtccctaaactttctcctctggccattcccatccaaatactaggaaagcggccaggtacggtggctcatgcctgtaatcccagcactttgggaggccaaggcgggcagattacttggggccaggaattcgaaaccagcctggccaacactgggaaaacccgtctctactgaaaatacaaaaattagccaggcttggtggctcatgcctgtagtcccagccagttgggaggctgaggcaggagaatcgcttgaacgcaggaggcggaggttgcaatgagctgagatcgcacaactgcactccagtctgggcaacagagggagactctgtctcaaaacaaacaaacaaacaacaacaacaaaaatgctaggaaagaaaagaaacactgaaaccggactctcttcagtcacctactggtgggcccaagctctcacacctcccttttctccatttccactctcagccctgaacactgatgtctgaaagaccgtgcaaatctccaagactatgaatcatcggttcagtgatacatgatggaatattaagcagctgagaaaaatgttttctaagaatatttaatgacaaaaggaaatgctcaccaaaggcaaacaacaacaggaaaaccaacctgtatacacagggtcatcccaatgatgggggaaaatacacattttttaaaagattagaagaacacatgccaaaataatgtcagtgatttcttttgggtagagaggttgtaggtgatgttgcttttctgggttttccaaatgttctacaataggcatattttacttttataaacagggaaaatgttacttttttaaaaaagattctatgatgatactttcctgggtaggaaagtggcctcaggtattttagaaaaatattgaactacaaccaaaaaggtgcctgacaatttgggtcatcagagcatttagctttcaggcagttttattgtatataaaacatttattttaccagaaatacaataaaaccctattagtctccttattataacttctttttttttttttttttgagacagtgtctcactctgtcaaccaggctggagtgcagtggcgcgatctcagctcactgcaacctctccctcctggtttcaagcgattctcctgcctcagcttcctgagtagctgggattacaggtgtgtaccaccacacccagctaatttttgtatttttagtttagtagagatggggtttcaccatgttggccaggctggtctagaactcctgacttcaggtgatccactcgcctcggcctcccaaagttctgggaatataggcgtgagccactgtgcccagcccccttattataacttattattacatattatatatataacttattgtcatacagtataatttcttattataatgattcatgtgaaccagaagtcaaatcatatatcctgaaacatgtagcaaaaagtcttgatgaaacaatcaggtagctgatagcttcctctgctgcctccaatgctgccaaggatgccgctgtattatgtcataagaaccacaaaagcactgataagttcccagaggttttttttttttttttttttttctgagatggagtctcactctgtctctctcaggctggagtgcggtggcacgatctcagctcattgcaacctccgtctccagggttcaagtgattctcctacctcagcctcccgagtagctgggattacaggcgcccaccaccacatccagctaatgtttgtatttttagaagagacggggttttgccatattggccaggctggtctcgaactcctaacctcaggtgatccgcccgcctcagtctcctaaagtgctgggattacaggtgtgagcccccgcacacagccaagttcccacaggttttaaaaacaattctcaaatgcatccaacacatcaaatatcagaatgtccctcatgctaattaagccaggctaagaggaaactgagtagtagcaatgccctatcctgggaaagagaaatgtgggggctgttctaaggagaaataaggcctgcaaaagctggcagcacccccaaggggcctcagaaatgcccttcagttggggagcagttgtgctgaagaagcacaagacagactatccttaccagacagaggaggaggcccatttttggcaaatccaatagatgaaactgattttaatacacaagataaattccagagtggcttttcattctataaaaggattcacagcaggattccattaagtagccggctcttctactgcattgaaagcaggattcaatagacaaacattcagctgtcatgtacctttataggaagacaatagctatctacacctacatggacaggcaatatctgaagggttgtttctgttccacttaccgagagcctgctgagctaaaagcatagatcgaccttccctacgactctctccccacccagctcaaggggtcaaagcagggaaggggtggggttcaattctgccacctcattcggaagcagacgcaggcaaggacctaaaagaaatgaggctggagaaaaaggaaacataagcaccatacaatgttagagctggaaacgcccttaaagatcacctaatccagccctttcgtttcacaaaaggggaaacagagactcacagagaggaagtgacttggctcacgtcacagactgatttagtgacagagaatagtgctaggatccaggcccctgtcgagccaacggccactctcaaatggaaaagctgactcaagtggcacatgtgtttctttagactggtaaaattccgggacattgagcttctggcttgatgctggtcaggggcagaagggtcaaggaaccgaatctggaaacccgtgagctccccaaggtggttctggcccacagaaggcaactgaagcagtcaatgcggtggaaggcactcattgtgtgttcctgctctctactcacttccccactttttcctcctgtttccctctcttttgactgcggcctaagtctcagcctggccagctgcccagttctgctgaagaaccccaagactaacacaagcctaagtctaggtcaaatatccccacctcaggccaggggtgacccttgctcagggtgagtgaaactttcccacaaaagccagccagattccctggaagccagacaattgaaagagagttttctaggtgttctggctattgttacctccaatctgctaaaaaagaaaaggtttacccacaggcctctgggtgaatgcccaactgccctctggggagcctgaatttgcctctgcctccatctggtcttgtttaatggggatctgaaaaaaacccagttcctgcctcagcgccagtgttcagagctgggggcctccaatgtgaaaggaaaccgaacacgacctcacacctcatcagggccaggaaaacagagttctgccccgttaccccagggccttcattccgggtcagagagggccatggcaggggaaacctgagccctgaggcctctcgctgagaaggcctgcagatcttttccctggtcacctttaagtgagtggaagggccggctgagagcgcgctgcataattcagcagatggctgcctctaatgagaagacactgaagaagaggataacattatttctcaccctcctgagcatgtggcctccttcctctgtgcaggcggcagagaaacccacggtttcaaatcccagcagcagaagcctcctcctgccaaactgaggaggaagggtctgtgtttctaatttattctgcgccccccactccagttgttacttaaaataatccatcattacatggctggtggctccaagatttttatttaaagcaatatggagaagaaaaaataaaaaagaaaacccacacaacccgtgactgtgctatattggatttaagctgagaatctttttaatatcagagagtctccgaatcaccctagtatactcttccctgggccctatgggagtgctgagggagtgtagtgaaaagagggggaagagaggtcatggcaggattttgatgtcttagaaacatcatgaaaagacaagtgtttttaaacaaggaatctgtgtcatctggtgggtgtttaatcgtatcacccactgaccagcaatagcacttcggactaagtaacttggtctccctacacccattaaataaagggaacagtaatacttgtccaggaagccattggggaaaatgaaatcatacagatggaagcatttcgagatcgttgaaagaaacatgttatatatatccatggctttccttctttccttctttttccttctttccttctttctttctttcatctgtctttttttttttttcttttttgagacggagtctcactctgtcgcccaggatggagtgcagtggcacaatctcggctcactgcaagctccgcctcccgggttcacgccattctcctgtttcagcctccagagtagctgggactacaggcacccgccaccacgcccggctaattttttaatttttagtagagatggg[134 bp omitted]acatgcaactaaaagcccttctcaattgttcatgctaatattaaaccatggctctgatcatccaaaaacccaggcaagtccagaaatcagccctacttagtttgggaatacctttttccagaggacttatcttcctaattggctttgctcaggctaatgcaataggtttgctcccttatagcacacaaaggcagtggccatgcttggtaacaaagccagcaattaatagaaaatttacagcagagactccacaaagtaaatgctatgcacatgactgcagatcaaaatctcattagatgatacagacaaatcactctgctataatgtagttttgtattaagaacaccgctaacactcacatttccaggatttaggatgtaaaaaggaaacagggcttattcctgcctttcatctggaagctgtgagagggcagagttcctgcgtgccttggccaccactatatcctcagcacctggcacggggcctggccgatcagtgcccagtgaatatgtgctgaaggaatgaatgaaaataaaagtgggtgaattggcaaatgaaatgttcccaacccagtagcagatgtgagatctcacccaccttcacacctacccatttcctatttgaagccctcaggaagcccttcctgtcaccctctgcctccattcattgctgagttaggttcccttagtaatgaaatctcatggcaggcagtcactctcctgtgtagcacttatcacaaagataattagatagtgatttgtgtctgcctccaccagttccttgaaagaagggaccatgtgcatttgggggacattgtcattctgcccgctttttattttgaaaaatcccaggccgggcgctgtggctcacacctgtaatcccaggactttgagaggccaaggtgggcagatcacgaggtcaggagttcgagaccagcctggccaacatggtgaaaccctgtttctactaaaaatacaaaaattagctgggcacggtggtgcacacctgtaatcccagctactcgggaggctgaggcaggataatttcttgaacccaggaggcggaggttgcagtgagctgagatcgcgccactgcattccagcctgggcgacagaacaagactccatctcggggaaaaaaaaaaaaaaaaggaaaagaagaaaagaaacatcccaaacacacagagaagttagaaaataatgtaatgactgtccaaaaacccctcaaatttagaatcaacatttttaaatatttagggccatgtaaactttcttccgtgttgtatcaccaatagagctaggtaatagggttttgttttctatgtttgaggtacgatactacctttagtgggtggtggtaggaacgcctgaagcagagacctcaaagggaatcaaagggtaactgccacgtgatgatagcaaaaccagagtgcagcagcaatcttttccccacctgaagacagttgctctgagacagttgacccagaccaaccccagctaactttgtagggcaaagttagcccctgaaagttcacttgggagaatgaccactacctagattgccactagagaaagcttcattgttcacattgtgggactagttcaagccagaatcatccagatgctcttggtatgggccggcatttacggtctggatcccagaatgcaacattgaaaggaacagctcattaaaagagccagcacatgcagcttttggggcttgccctgtgccttggttaccttggacaagtcatggaacctctcgaaatatatattaatagcagcccaagccacctcatagtcagggggtgaggtggggcatcacaaggatcttctatagttctttaattatttcacagtgtccacaatttgtcattccaactagactataagcttaaaagccacgaacttttttttgttttgttttttgagacggattcccactctgtcgcccaggctggagtgtagtggcacgatctcggct[135 bp omitted]ctcgatctcctgactttgtgatccacccacctcggcctcttttttttcttttttgagatggagtctcgctctgttgcccaggctggagtgcagtggtgcaatcttggctcactgcaacctctgcctccagggttcaagcgattcttctgcctcagcctcctgagtagctgtgattacaggcacgcaccaccacgcctggctaatttttgtatttttagtagatacggggtttcaccatgttggccaggctggtctcgaactcctgacctcatgatctgcccacctcagcctcccaaagtgctgggattacaggcatgagccaccaagcccagtccgatcacgaacgttttttaaagcctgctacctttttttgtccagttgacaagggctaaccatagtgctggccacatatcagtcaatcaagtaaatatggacacagtggagaaatggtgttgtcacaccaaaccgtttgtggtgttcattcaaatgggacggacttgtattatgtgcaccagaattgaacttccaagttggctgcgtgcaatgtaagccctacccaacaacttgaaggcttgttttagtcactaaggatgtttacccacagtgactctcaactgattctagaaagaacacaccccccacatacatacacatacacacacacacacacacacacacacacacacacacacactagggcacttactcgcatggtaccacgtctcagagctcattaaaaagaattcctggccgggagcagtggctcatgcctgtaatcccaacactttgggaggctgaggcgggtggatcacaaggtcaggagttcgagaccagcctggccaacatggtgaaaacccccctctactaaaaatatcaaaactagccaggtgtggtggcgggtgcctgtaatcccagctactcgggaggctgaggcaggagaatcgcttgaacctgggaggctgaggttgcagtgagccgagatcatgccacttgcactccagcctgggcaacagagcaagactccgtctcaaaaaaaaaaaaaaaaaaaaaaaagaattcctaagctagccacacttaggtttattctctagtcttctgttcccaaaccctgaatacatgttccttggaggaaacaagcagcaaccagatgtccaaggtctcctgagttaactccgtcttccctggtgaattacaacttattgcagacacaaaggagaacagagagacaaatgacacataaacaggagcttcactggctgggggaggggggcatggagagtgacgtcagttttcccagaaacccatttatcacgataacaaggtctcgagtgcttaggctgctctttcagcttcagaatctggcgtacaattatgttcttcatcatacagtatggcaaggccagccagagcaaactggagccatgcaaagcaaaccaagtggccctaaagcaccccctcacccccatctgcagaacaaagggcatctctaggttgcctgagttgtgcctgaggtgaaacacacacaaccttctggaatgttccccattgcaacatctgccctgcaatcctaatccaggcaagagaaactggtgagagtatggaggacaggtcgatgcaaattcattagctgacatgaaaaatcattagcgtcatttttggatggagctagtgtaatcccagagattaattcctctacttcagctataccatctctgaaatgcaggtaaccaggagcagaaaagccacagcagaaaagagggagccctcaaaacactaaagcaataaacaacgagagtgccaatcttgggggaagaaaattctctcaaattgcatcatcacagagaatgtcccctgtctactcctggtccttccacaacatgactgcataaagtgctctgtgctagggtgtgcagggggtggaggaggttccgaagaaatgatcctgcccttccaaacagggacaaaagagacattaatacatattctgtagagaaaatattatcagattctggcttcagattttgtaaaatcaatttcaattacaccaaatacctagaggctttttttttgtactgtagttgcattgcatgaactattttcctaaataagtaagctacaaggttgaaaaacatttttatgtggttcagagattttcgtcaagtagtatgtggtgtcatgggatttgacctacctctgtctcccactccttcctcacctcggggtgctggtgggcttattaaagtcccagatacccatggatgaatagaatagctagggtgtcccccccaaatggaattcatcgccctttgcaaccaaacttctggtttaaaaaacaaacatggagcctcaggtcacttcaacatggtttctctgcacatcccaggctggaaaacttcagttctttaaatgaagattttttttttcccagagtcggtcgccaacaaaaaaagagacggcaccgcttttgcgagtctcacacttattttcctgagtctccatagaaagaagccagctccacaggttttggcacacaagcccagttacactgaacatgcacccgagacagatcctcagaggcccgctccaaaacatgccaaaatacgcagccagccacctacaggccagccaactgcaccccacactgacgcacaaatgagacccagaggcacacagcacaagcagacagagaggcgttcggacacacaccacagaggtgagcacactcagagaaacacgcggacttctttgggtcacagacagaaccccggcgccgccgccgcccgcccgggaagacacgagcgcgcgcgcgtgcacacatacgcgcacaccgatacacacacagacgcagtcacatatgtaatgcatatagagaaaccctatcccagccagtcacctccccgcccccctcgccactcaccgccttctgccccaggctaaccccagccccgcgcctctttgcctgtgcggtcccgggtcacaacgggcagccgtgcgcaggggcgcggcaaggccagggtgccagggacccggagggctcggcggctcctacggccattcattcggcaacgccccagccgtggggccgcagctgcagcgagggaggcggtggcgctcactgcggctcttgggcaatgcaagttcagccgccggcccgcaggttttgcctgcccccctgccgccccccgccccccgcgcgccaccaccgttttccgggacaggctgagggactgagctgctgaccccgggagcagaagtcccaccgtgcccttggctcctggatgctgcccactgccctcctcgcgatgtggcggcggcggccaggtctccttgaccctcaccaggccctcggccccggccctggcacccaagctctgcacttaccacctggcgagctatatcggtcgctgccatcgctcctgcgtccgccagggctgccacgggtgccgccgcaacgggagctactgcacaggaaacagaggagctcctccgacaaagagaaagtgttacacttcgggcgcgaccaagtccggtggggggaggtgcaagggaggggccccctcgccgctgctccaaccccaacctcccctctaccgcccaccccttgaaagtagggtatggagagggggcggatttaacgcgccgcttccccctatggccagaccagttccagttcttcctgcaaccccagccataggcttctacgaaggggggcgggggctcccctcggtgaccacgtcctctgccccccccgccacttggctccgtggtacgtcccgacctctgctgaattgtcacacccccctgctctcctttacatccctaagtccccagaccccgaaggctggaagggagcccccgcccctcccccctcccatactctgctcagcggccgagctctgcagttctcctcccggcccccgttaccccccttcctttccaccgagatcccaaggtgcttagatgggtgcgccttggccgctggagtctcgatgccccactgtcgtgtctccctccctccatggcccgggagcgcagctgcggccgaggtaccggggaggcctgcggcacctgccgctccacagtagagcttagaaagggggcccgtggggggagccgcactgcagcccggcaactgagctgagctgtggcatgtggggtccgaggctagaggtcttgagacgctgcttctgccctggggtttccaagccttgggtgctgtgggctgtaatttcgtggagccaagctcaccacctttgggtacctagtacagacggaacccacgcctcctctctccgacccagccctagacgctcagcaagaccacccaccccttctagtaccagaggaagggctggagatgaaggttctcagctctatggagcgaaatggaggggcgggtgacggggagcggcctccagtcactctgtcccgccccctgatttctccttgaccctcattcagcccgggacaaggcggccaatagggcgcagaggagagaacttccgaaggcaggggtgcgcccgcccgccctccttatccccgtggcccacctccgcgggtcctctctcgtgggcacctctccacttctccggccttggcgccctcccctctctcttgggactggcctcttgctagctccctgtcactggagcacgctggcagatttggcatgcccgaggccccagcgggagggacagtacattccactcctcaaaagggcaggttccctggtgtgggagagagacctgggcccgccagagggaccccagatgggggaggggatgacaaggctatggaggaaacccgggcccaagagggggccccaatggagcatggaagatgaccccgtaaaggcccaaggctggagcagctgaggaggaggcaggagagagggaaaaagaaaagaaggaaccagggagagagaggaagaagggactcgatccagaggccctggtctcggagaagtcagggaagacaagaaaatggagtagccaaagaagagcatgcctggcacttggttccacctgctggatggagcttctcacactctctcgggaagccctttatgtatgtaccctgtgcgcctggagaacaaggactcagcaaacgcatcccagggccgagtgcagggcctcgcagtcaggaggcactctattaagctgagggcagagaacttggatgcgtgcgaggggggcggggagaagaaagaagagacacagtgagggaatagcagtaaggacagtcatgaagagccaagtattcagggagcgccactgtgcgccttcattgtgctggagacccaggagcggcctaaagagaagagcctggcaaaatcagggatcagcgcagaggagctccgcgagacagaaggcgcaggccatagggcggatggcggtggcaaggaagaggggcagctggagtctttcagactctctggagctttggggcagggcctgagccctggactgggttggcagtgacacgggggaccagtgctatatctgaggaaccacggtgaggcttgggccccaaccgcatgggggcggggagtcagaggtgactggcggcttccaggctgggtgtctgggacagggctcttccctggcaaaggctagggcgtggtggactgaaaggccccgaggtcactagccccgatctggacttggggtttgggtggtggtgggacaaaaggggagaatttggaagccagagcagaaagctgctgccggaacgggaggggactggagggctgcgggtctcccgggagaatcccccacgcactgccccgcccgccttagcactcctcgcggactgaagctccgtacttaccggcccagcgctgggggcacctgagcacggaatccttggtgtctcatccatatgccccattcggccctcctgtccctagagactaccagaacctcactgcgtcctcctcctccaaaacgctgaacctcgaagacctgaactaagtgcttaattcaagtctcctgggaccctttggttcctccaatacctgcccacctgcggctacaagtccctcctggggcctgggcctccagcctccttcggtggggtgtgggtcagtgtgtgtgttggtcttgatgtgtgagtagatgtgtcggtgtgttcgtgtgtattgtcagtgtgtgctagctgtgtgtctgtatatctgtgtgtcaatgtgtgtgttggcatgtgttggtgtgtcagtgtatttcaatgcatggtgagtgtatgtgtgtcaatatggagagaggtgttagctcactagctttacataccttatctcactcagtgcagtgggccgacgactgagacgtgtgaatcagaacattcatttcaataaagaggtttggaaactctctgggatcatgcctttctttttttttccttttttattttttttttgagacggagtgctctgtcatccaggctgcagtgcagtggcgtgatctctactcactgcaacctctgcctcttgggttcaagcaattctctgctgcagctgggactataagcgcccaccaccacgcccagctattttttttttttttttttttttgtatttgcagtagagacagggtttcaccatcttggctaggctggtcttgaactcctgacctcgtgatccacctgcctcggccttgcaaagtgctgggattataggtgtgagccaccgcacccggcctgaaatcatgcctttcagtctttgtcccgggtcaccttcccaagaacaggggagatggaagggctgaggaggcaagagggctcatgagtggtcagttcgtgagttttcttccttgaatgtctgtcctcgttgatgagtgaagccaaaagattcccctttatgaagagtcatttgggactcccgggcgcttccatgaacatgtatgtgctcatgtttgatgtttccttgtggggtcccttgggcccagcatggtgtctggcaggtgttcaatcaatgtttgttgagtaaaggaatgaacagaagcatgtaaatgaggtggcttcagtatttccatgtccttaaagaagctgcaacaaacagagacttcccaggggcaagcaggtggctgtcattagcatgccaatgtttgtggagccagactctactgcctgggagcagaaatggctacccctgctagataagagtgggccctaattggagcccagctttccacaggtcactgctggagttgggggtgctaatactggatagaggagcagcaagcaactcaggggcagggagggagaagagggcactgaaatggagctaagaggtcaggaaagggctttgtcctgaaactgtggctttgtgataggagaacgagaaagatggtagagtcagtctcaagtggagaagccctgagaaccatctgaaaaataagatcagaaagttggaggaggggccgggcgtggcggctcatgcctgtaatcccaacattttgggaggctgaggcaggtggatcacttgaggtcaggagttcgagaccagcctagccaacatggtgaaacccccgtctctactaaaaatacaaaaattagccgggtgtggtggcgcatgcctgtagtcccacctacttgaggcaggagaattgcttgaacctgggaggtgaaggttgcagtgagccgagattgtgccactgtactccagcctgggtgacagtgcgagactccatcaaaaaaaagaaagggagggggagagagagagagaaaagaaaagaaaagaaaagaaagagaagaaagttggaggaggaagacaaggtgaagcagggaaaatgatccgggattcaccaaatccagacagtgccaattaaatcagaaactctgtgaaggggctgagtcaaaatgaactaaagatccctttcctcaattctgcattatcacctgctgcccctggttttgctttagtttctttccagtgtttcttaaaatgtggcctttgaagcatcagcagcatatgggaagttataaaaaatgcaaattattgggccccacccgagacctactgaatcagaacttctaggatgggacccaggaatctgtattttaacaagtgctccagtggattctgatttatgctgaagtttgaagaccactggtttatcttgaaaatctagccctgatgggttgggatacaggactggtaaggtttggtaggatattgaaggagaagtttgaaggccgggccattgccaataattgtagatctgttggatttctatggtgggaggagtgagggtatgggaaagggggtgccaaaaaagtaatagaagggaacccagcaggagctagctcactagaagagttagaaagataaactttgcctcccgatatggttaggctttgtgtccccacccaaatctcatcttgaattgtaatccccataatccctttgtgtcaagggagagaccaggtggaggtagggaaagaccaggtggagataattgaatcacgaggtggtttcccccatgctgttatcatgatagtgagtgagttctcacgagatctgatgggtttgttttttttttgagatggagcctcaacctgtcacccagggtggattgcagtggcacaatcttggctcactgcaacctccgcctccagggttcaagcgattctcatgcttcagcctcccgagtagctgggattacagacgagcgtcaccacgcccagctaatttttgtatttttagtagaaagagtgtttcaccatgttgaccagcctggtctcgaactcctgacctcaagtgatccgcctacctcagcttcccaaagtgctgggattataggtgtaagccactgtgcttagccagacctcatggttttataagggactcttcccccttcgcctggcccttctccttcctgatgccttgtaaagaaggtgccttgcttcccattcacttttggccatgattgtaagtttcctgaggcttccccggccatgctgaactgcattaaacctctttaaattacccagtctcaggcagttctttatagcagtatgaaaatgactaatacaccttctttgcaattttcattcattccacaaatactcactaaatctcaactgccaattgctaagtgccagaggactcaagaaagaataggtgacaagaactcctaccttcaccttaagacactcccaggacagttgccagatagctctacaaacaaccagtaatgtgataagtgatataattggtcaggagcaacaccctggggaggaagacacccagagaggtgagggaaggtatctcaaagaagagccatttggattgaatctttaagaatgagtggtggtttatctggcagtcaagagggggcagcagagagaatagcatgagtaaaaccagaaagaaagggcagagagcatttcaggaattttaactcttggccagagggagtggtaggaagaggggacagtggctataaatgagactggaagataagatggggctggatctggaaggatcaggttggtcataccaagttgcttacactttttgctccagaataggggttctcaagctctgctctccagacaacgcctggaactacgcccaatgtaaatgggatgctcacagtgcaaaaaaaaaaaaaaaaaaaaaaatcagttaatgggtagaaatttctctatttgaactttttttaaccataaattttcctaaatctttgacagatgctcctgcttatctgctagcaagtaacaaaaatgaatgaacaacttgccaacgaatataaaacagacaaacgcagtactaatcatgcttaattcaacagtttattttttcacggacatctgtacttgtggctatgattttatattgcacacacataatgtggacatatttttagctagcagaagtgttcttttgaaaagtgttttatttcatatggcatgatttaatatatgaattatttcattacattctggaaagagcaccaccacatccagatgctatgccacctgaaccagttggagaaactatcccttaaatagtgaggagtcactgaagagttttgagcaggagagtgacttgaacatatttgcaatttttttttttcttgagatggagtcttgctctctcacccaggctgcagtgcagttgcacgatctctactcattgcaacttctgcctcctgggttcaagcaattctcctgcctcagcctcccgagtagctgggactacaggcttgtgccatcaggtccagctaatttttgtatttttagtagagatggggtttcaccaagttggtcaggctggtctcgaacttctgacctcaggtgatccacccgccttggcctcccaaagtgttgggattacaggtgtgagccaccatgcctagcccatatttgcaattttgaaaggtcactctctctccagcttgggaaaaagattggaacagaaggcgattaaagcagttaggggccaggtgcagtggctcatgcctataatcccagcactttgggaggctgaggcaggcggatcacttgagctcagacgttcaaggctgcagtgagctatgattgcaccactgcactgcctgggtaacagagtgagacctcaactctaaaaaagaaaaatatgcaagacttgggagtgaggacactgctgtagcagttcaagcaagaaatgctggtgacagcgacatgagagtggagtggcatggaaggaatagactcagcattacaaggggccacccattaaaggtcttgtgtgccattctatggatgctgaagtttcaatgtgtagggaataaaagagcctttgaattcctgtttcttaatgggtggtacccaaccagctgcatcagaatcacctatagtgttcctaacagatgcagggccctagagcccacctcagatctgctgaatcagaatctctgtatgagagaaagaatgtggatttgtaccaagcactccaggcggctctgaggcacatcaaagttggagaactactgcgtgaatggttattgagcagtggcatgacagagtgagatctatgtttatgcagatcacttgagtcaccacatgaagaactgattgaatgaaggtaagactagaggcaggaagccgggcgcggtggctcacacctgtaatcccagcactttgggaggccaaggcaggtggatcacgaggtcaagagatcgagaccatcctggccaacacagtgaaaccccgtctctattaaaaatacaaaaaaattagccaggcatggtggcacgcgctggtaatcccagctacttgggaggctgaggcaagagactcgcttgaacctgggagttggaggttgcagtgagccaaaaaaaaaaaaaaaagactagagggagactagttagcagggtactgtaatagtcctcagctaggcaagacctggaactcaagagaaggctgggcttcccacccacatcatgacatactagttatccttataccctggtttatacacactgatttagacaaacgatataattttgtattcccccaaacaactgttgtttgctcagcagtattcccagagccatagagtacgatcttgtagaaagtattgagcacctgccatatctaggaccctccacta[131 bp omitted]catggtaaaaccccgtctctactaaaaatacaaaaatttcctgggcgtggtggtgcatgcctataatctcagctactcgggaggctgaggcaggagaatcacttgaacctggcagggacagaggttgcagtgagccgagatgttgccactgcattccagcctgggagacagagcgagactccatctcaaaaaaaaaaaaaagaaaagaaatataaagtctagtttctcatgcaacactcccatgtaacaaacctacacgtgtacccccgaacctaaaaaaggaatggtggggtatatccagaaaaaatatagttttgttctgaaagagcttggtgtctaactggggagactacacacacacacacacacacacacacatacacacaaagtcaaatagcaaataccaaatacgtcataaggcagtatccaaggtgtagtacagacaataaataccaatgttctacttcccggtggtctttacatgggtgtttgctttatcaatattgattctgctgtattttatgctttaggaactcttctggatgtatgttatatttcacaagaaaaaaaagtttacaaagacaccgagttctgcaagttgagtgatactgatcaacaacccatagatatggtagagaattgagagaaacaaggtctgtacccagtggcctcacagttctccacagacaagtcacaaagactgtgagaggattgaaataagacacagaaaaataagagacagatagaaaaagatggtaatgagccaggcgtggtggctcacgcctgtaatcccagcactttaggaggc[135 bp omitted]gaggcaggagaatcgcttgaacccgggaggcagaggttgcagtgagccgagatcacaccattgcactccagcctgggcaacagagcaagagtctgtcagaaaaaaaaaaaaaaaaggccaggcacagtggctcatgcctgtaattccagcactttgtgaggccaaggcgggcggatcactaggtcaagagatcaagaccattctggccaacatggtgaaaccgtgtctctactaaaagtacaaaaattagctgggcgtggtggcgctcgcctgtagtcccagctactcgggaggctgaggcaggagaattgcttgaacctgggaggtggaggttgcagtgagtcgagatcacgtaactgcactccagcctggtgacagagcaagactccgtctcaaaaaaaaaaaaaaaagaaagaaagaaagaaaaagatgataatgacaccttggtgagatattggcttcaccatcaccaccattactcattgatcaagatgagatatccattttatatcaagctctcaatactttgcatttatgtactgatttctttttgtacccatacactgtgtacacagatacatgtgcacacccatgcacacacacacgcacatctcattccaaaacagattttatgggtacatcaggatcaaaacagagaattcaaatatgctatttctagtgggttgatataattgctatgattcagctttgtattacactggagtctccagagaaacagaatatatgtatattaattttatatacttattatattaacatatatgatatttattataaagaattggcccacatgattatggagtctgagaagcccgacaatttaccatctgcaacctggagaccaggaaagtcaggggcacaaaattccagttcgaatccaaaggcctgagaaccag[135 bp omitted]aacatggtgaaaccccatctctactaaaaatacaaaaattagccgggagtgatggcaggggcctgtaatcccagctacctgggaggctgaggcaggagaatcacttgaacccaggaggcagaggttgtagtgggctgagatcatgccactgcactccagcctgggccacagagtgagattctgtctttaaaaaaacaaaaaagatccaaggacaggagaagagaaatgcctcagatcaacagttagggaaagaaaggcaactcaatcttccactgcatttttttaagagacgggatcttactctgtccccaaggctggagtgcagtggcacaatcatagctcactgactgcagcctcaaaatcctgggctcataagctcaagaattccttctgccttgggctcccaagtagctggaactgcaggcacttgccaccatgcccagctaattttttttatttttagtagcgacagggtctcactttgttgtgcaggctgatcttgaacccctggtctgaaacaatcctcctgcctcagcctcccaaagcactgggattgcaggcataagtcattgggcccagcttcatctgttttttccttctattcaggccctcaacagattagatgatgcccacattggggaaggccatctgctttactcaatctaccagttcaaatgctaatctcttccagaaacatgttcacagacacatcctatttctgggaatcccttggcccagtcaagttgacatataaaattaaccatcgcaagctttaaatatgatttttagctttctggaaggcatagcaaaaggaaaaatactagcttgcatagttttatgtatttcctatacacaaaggtcactatgtgattcattaatcccacaaatatttattgagtacctaccgtgtgtcaagtcctagactaagtgctggagattaacagtgagcaaaagcagacttggtccctgacttcatggagcttacagtctaatagggaagacagatagcaaacaatatcacacacattaatgaaaaaataaaactgcaataagagcacctaggagatactcatggtgccctgagagcctataatggtggtggggtgggatggggacagatttgacttagtctagcagtctagtatgtccatctatgaggcttcatggaggaagtgacgtttgaattcagatcagaagattaaatgggtgtgagcaaggtaaagggaggatgggagtaggaagagcattccaagcaaaggaaagagcatgtatgaaaactctatgcaagaaacagagggtgggagtggtgacacacacctgtaatcctagcactttgggaggccaaggcaggaggattgcttggggccaggagtttgagaccagcctgagcaacatagtgagacctcatctctaaaaaaaaaaaaaaaaaaaaaggttaaaaaattagccaggcatagtagcacatacctgtagtcccagctacttgggaggctgaagtggaaggattgcttgagtctggaggtggaggctgcagtgagctgtgattgcaccattgcactctggcctgggcgacagagcgaaaccctatctcaaaaaaaaaaaaaaagaaagaaagagagaaagaaacaaaaagaaaagaaagctgatgtggctgaagtgcacagggaccagagcaggatgaaatgagactgaagaggtgagcatagagcaagatcacacaggcccctagaccaacattaagggggatatttttatccaacaatataaaaagcaaacaggaagcaacaggaagccactgagagtcttaagacaggagagtgacataatcagatccatgttctgaaaagttcccttgtcttcagtgtggacagtgtattgaaaggcaaaaagagtggaggcaggaaggtcagttaggaggctattgcagtggtccagctgagagatcatgcgggcttgtactagggtgttggaagtggaaatggagaaaagaaaacttctttgggagatatttaggagggaaagacaacccagacttggtgatgggaggtggaggatgaggaagacagagatgccaaggacaactttgaggtttctggcttatgtggtggtacattttgttgagatggggagcactggagaacctctgatttggggaggaaggagaaagtctttggcaccagtttgggacatgttgagtttgagaagcttttgaggcattgaaggggaagatgtcgagtacgcaattacagctcagaggagagataaaagtataggagtcattggtttgcaggtggtatttaaacccatgggaatagatgaaatgacctagaggactcaagactaatccctggaaaacctcaacattaagagatggaaaataggaggaagaacctgaaaaggagaagccagagaggatggaggaaaatgcagaccaccacatgccactgaaacccaaggacaagaggatttcaagaaggtaatggtcaacaaaactgaatcctggctgggcgcattggctcatgcctgtgatcccagcactttgggaggccaaggcaggaggatcacttgagcccaggagtttgaaaccggcctgggcaacatagaaagaccccatctctttaaaaaaaaaaaaaaagagctgaatattgccaactgccaaaaggtcaagggagataagggaaaactgtccatagaatttagggttcatggagctcattgagctaatcaagagctgttttgggagtgtgatggtggcaaaaaaaaaaggctcaagtatgctgaagaatgattgggaaatgagcaaatggattcagcaagtactatatagccaatttgaaaaaacaacatggctgtaaaggaaaacagagatggtatggtagctggagaaggatgtagaggtcagagtttctttaaagatggcaggctgggcgtggtggcttacgcctgtaatcccagcacattgagaggccaaggcaggcagatcacttgaggtcagaagttcgagaccagcctagccaacctggtgaaaccccatctctactaaaaccacaaaaagtagccaggcatggttgtgggcacctgtaattccagctacttgggaggctgaggcaggagaattgcttgaaaccaggaggcagaggttgcagtgatccaagatcacgccatagcactccagcctgagtgacagagtgagactctgtttcaaaaaatagacaataataataataaaagaaagatggcagaaaagacatgagaatgttaaatgttgttggaaaggattccggtgaaaggtagtgattgaatacacagagtactgggctggtaaatgtttagtaattggctttccaagaaaaaaacaaacaacaaccctgctgtgcatcatttgccgatttccatggtgtaaaatactctcactatgactgatttcaggctatctatgtgacgtttcaagccccgcaagcaggctgtagcacactgctgacaggagaaagaagaattgaaattcgtagttatcagccaattgtatcttctcttttataaatttcctgtacatgtccttagctcacttttatattgaaacacttatctttctcttgggaattcacagaggtctttgtgtacatatgaatattaatcctttctcatttacttatggtggatttttgtataagagttttaaaatatttatgcagtcaaatctatcaatacttccctttatgatatttgcccttagtgttcttcattttattgtaaattactaaattgtcactctgctttgatgaatgtgaatttggctagcatgaattatctttcggaagctgaggtgttttaaattgcaaagacgaggaacaaactgtagatcttagtatattcaccaaggtattagcatcctgtgtggtctttcggtggccaggtaacactcctaatttcatcttttttttgggatggaatctctctctgtctcccaggctggagtgcagtagcacgatctcggctcagtgcaacctctgcctcccaggttcaagtgattctcctgcctcagcctcctgatcagctggaattacaggcgagtgccaccatgcccggctaatttttgtatttttagtagagacagggtttcatcatgttggccaggctggtctcgaactcctgacctcgtgatctgactgcctcggcctcccaaagtgctgggattgcaggcttgagccaccgcgcccagccaatttcatctttacaactaagtatttaaaatatcataataggacagaaaacacttgcaaagggcctgctcccttctttttacatttcttttcttttcttttggagacgggctggagtgcagtggctcaatcatggctgactgcagcctcaacctcctgggctcagctggtcctcccacctcagcctcccaagtagcggggaccacaggcatacgccaccatgcctggctacgtttttttgtttattttttgtaaagacagtatctctatgttgcccaggctggtctcgaactcctggcctcaagtgatccacccacctccacc[132 bp omitted]tcactgtagccttgacctcctgggttcaaatgatcctcccacttcagcctctccagtatctgagactacaggctcacgccactatgcccagctagttttttgtgtagacaggggtctccctatgttgcccaggctggtgtctaactcctggcctcaagcaatcctctcaccttggcctcccaaagtgctgggatttcaggtatgagccaccactccccgcccttctttttaaatttctactccagtgatttgaatgtgtgtttcaatcacctggacagatattttccctgccatggcaaatacacattcagggacctttaggaagctggtgacaaggttttatcattacctgccaagagagacctcaaaagataatcagtcatggtattttactcctgttagaaataatcaagataaaattgtaacccctgactttggcacatattttctgtaactcaattggtcaatattaaataactttataaaatagattcagtcacctgagggcatattgacttgcagctaattcaacgaagcagactcatggagaagtcatgttacttaaaatcagacattccacagtgtcagccttcagctgagagaccaagtcaaggatacagtcagggtttaaaggggtgaataaactggtggaatacattcattcattcatttattcaatagagatttatagaacattttgtgtgtgctgagacctgtacatgacattgggaaacagtggtgaacaagtgcattatggaatgtacagtctgggtgggagttgggggatgaaaagtcacataggttattataatacagagtggtgaagaaaagaatggggtcctcaggatgggtacccaattgagactcaggtaattaaggaaggctttacagatgcgttgatacctaagttgatgcctgaatggcagtaggaagtggctgggtaaaataggcaaaggaaattatcaaattatcagaatgaggtctaagaacaaaacactggtaaccagaaatgggttgggaaatgccagatgtcaacaaaagcacaggggtggattccaatagtgtgaatctattatcttgaactggagtcaaaactgagggtgagtagggatgtgtatgtgggggaggaaggggtagttctttctgcggagacatggggcatgggggttttgaagacatctctaaagcaaggcagaaatttcttggcttaagtgtggataagatcttgtcagaaaggataaaacacccctcatctaagctcgcttttttttttttttttttttttgaaacaaaatcttgctttgtcgcccaggctggagtgcaatggtgtgaactcagctcactgcaacctctgtctcccgcgttcaagtgattctcctgtctcagcctcctgagtagctgggattacaggtgcacaccaccatgcctggctaacttttctatttttagtagagacggggtttcaccatg[135 bp omitted]aaaggggtccttcatgtggcctttgcagtgctgcaatagtattgaggtttttctatgaccatggaaagtgactgattaatgctctgctctgtattatggaacatggggactcaatgaagcatttttttgacatgttggcaaagggccaaaactatttcctgagaaagatctgggcttcactgcaagtagcttcatggcccacctccatgagagctcctacgacctcccattcaggcaagaccagaggtcgagcttctcaatttttgtaatagaatatctacaaagcacctctgctattggtttccaaaatatatgcattagccttcaataaacatttttaatttagagctaaaatactagctctctaagcccttgtcagagattacagttttaaataacccaccatggagttctgatcacaaatctagccatgagacctgaaattttagagaagtttgtttaaggcaatgtttctccattgtaggttacataataaaaggtgtagatatgtacgggccacataaatcaataataatggtgaaatatggcttgttgtttatttaacaatatgtattgtggagacagtaatacaaaagcacccccaaaagttgtatcaactgtattcactcaaaagtgcatatttataggcctactgttggtcattggtcaagtctgactgatccaataataagaatagaacattggtatttaacaaaataaactggaacagcgggagctattcagcctgggcctgtctcatgctggctctggagacagactcctgatggaagcttcattctggaagttgtcagaaagagaatgcgctttcagctgcatcacgaagaccctaatctcgtctagagtttggccatctagcctgagcaattgggataaacgtcacctgcaaaacctgggggatggtggctgggcgcggtggctcacgcctgtaatccctgcactttgggaggctgaggcgggcagatcacgaggtcaggagatagagactattctggctgacatggtgaaaccccgtccctactaaaaatgcaaaaaattagctgggcgtggcggcacatgcctgtagtcccagctactcgggaggctgaggcaggagaatcacttgaacctgggaggcagagcttgcagtgagcggagatcgagccactgcactccagcctgggcgacacagcaagagtccatctcaaaaaagaaaaaaaaaacctgggggatggtgtacttcttggttgctccagttcactgagctgaatgttgacacactctagtagtaggtttcataattta[135 bp omitted]tgtgatcccagctactcaggaggctgaggcaggagaatcgcttgaacctgggaggcggaggttgcagtgagcagagattgtaccactgcactccagccttggcaacagagcaagactccctctgaaaacaaacaaacaaacatacaaacgaaggtctgtacttccaagtcaatcataaaaatgtctttaaaattacattcttttgtttatgaaaataaaacattgtttatactcatcaaaacctatgaatgaggtgaatttagtggtatgtggattataactcaataaggtgttatataaaaagaaaaaacccgtctgggtgcggtggctcacgcctgtaatcctagcattttgggaggctgaggagggcatatcacaaggtcaggagttcaacaccagcctggccaacataatgaaaccctgtctctactaaaaatacaaaaattagctgggcgtggtggtacacgcctgtaatcccagctactcgggaggctgaagcaggagaattgcttgaacctggcaggcagaggttgcaatgagctgagaccgcgctattgcactctagccagggcaacagagcaagactccatctcaaaaagaaagagagagagagagagaaagaaaaagaaagaaagaaagaaagaaagaaagaaagaaagaaagaaagaaagaaagaaagaaagaaagaaagaaagaaagaaagagaaagaaagaaagaaagaaaagaaagaaaggaaggaagaaaggaaaaggaaaaaaacctatgagtctcttctgaccatcccatcactgtgccttaaactcacctgggccttctgcactataccaaggctgctacaggaaacgcaaggcaatcaaccatgcttggcatctaccgagcctggcccaagcctgaggactggctctgacctcctgttactgctttggtctttttggcttgcaggttcttggctccgcatatttcacctaagtgagagaggctccttcctcacttcctgggctctcagggccctgtggttgaaactctcttctgcacccctcctcctgtatccagggaaaagaatcctcatgcaattgtgacttatttcctaccaaatatagtgcagcattcttcaaaatctatgagtgcattgaactcaagacagtttggcaatggaaaatgagaggtttccagtcatcatctgcccaatccgcatgtccagctgggggtctgcatttccatgaacaaatcaacagagcttttatttgtctcttgcagtttcaagttcaatgtgttcagatgtcttgtcacatccataagaaaatacaatcttgtgaatcacggaaggtctaacaaattagatttggtggctcctttattgcaaaaagcccttgattggaggtgacagctcgataaatctacatacttgtgatcagtctcttctaaatagctcataaactggtcatggttaaaggcatgaacacagagaaaattaataattttcattgctttctccatcaacagtatgtggtaaactggacttgcaaagtccatgagatgaagcatgaggcaatgacagctgggtccaccaaatttctcttgacttgaatacatggttgttttttttttttttttttttgagacggagtctagctctcttgcccagctggagtgcagtggtgcgatctcggctcattgcaagctccgcctcctgggttcatgccattctcctgcctcagcctcccgagtagctgggactacaggcgcccaccaccacac[184 bp omitted]ttgccaggctggggtacagcggcctgatctcagctcactgcaacctgtgcctcctgggttcaagcaattcccgtctcaacctcccgagtatctgggactataggcgcacaccacca[257 bp omitted]cctccgcctcccaggttcaagcaattctcctgcctcagcctcccaagtagctgggattacaggtgcccgccaccgccaccacgcccggctaatttttttgtatttttaatagagatggggtttcaccagattggccaggctggtctcgaacttctgatcttgtgatccgcctgcctcaacagatacattttcttttcttttttttttgagacggagtctcactctgtcacccaggccggacagatctgcactggtgctatcttggcttactgcaacctccgcctccctggtacaagcaattctctgcctcagcctcctgagtagctgggattacaggcgcccaccaccacgcccagctaatttttgtatttttagtaaagatggggtttcaccattttggccaggctggtcttgaactcctgacctcgtgatccgcccgcctcagcctcccaaagtgctgcgattacaggtgtaagccaccgtgcccggccgacagatacattttcaattccttttttttaaggcagggtttcattctttcacccaaactggagtgtagctgcacaatcacagctcactgcagcctggacctcccaggcttaagtgatcctcctgcctcaggctccagagtagctgggaccacaggggcatgctgccattcccagctttttttttttttttttttgtagagataggggtctcactatgttgcccaggctggtcttgaactcctggcctcaagtgatccttccacctcaacctcccaaagtgctgggattacaggtgtgagccaccatgccctactccagttccttttaaggggagaagtgctatgcagtaagcacagggtactgagagaccacagaacagcaagttaaccagatgtgggtttggaaagacttcctaggccttgaaggatgagtaagagttagctggggaagggggagtcgagattagatacagtctaggcaaaaggaatagtatgtacaaagacaagaaggaagaaagaacatggtatgttcaaggaactctaagatattgtgtgactggaagtcagagtttgaagatactggaaattaccagtagccataccattgcctcgggtgccatattgaggagctttctccatattgtggtgaatgagaattcaaaatattcaaacagaggataaacacagtcagatatgaatgttaaaaggatatctgtgtatacctaacagaaaacccccaagggttagaatgaaaaggaaaaagacatttaaaaggaaatataaaatttgaacagcattataaactaactaggcctaaagacatctataaaacactctacccaacagtaacagaatgcatattcttctcaagtgcccatggatcattctgcaggataggccacatgccaggccgtaaaagaagccttaataaatttaaaagtattgaaatcatacatagtatgttctccaaccacaatggagtgaaattagagataagttaggcaaaattttgggaattttgcaaatatatagaaactagacatggagttggctgtcctgtagggaaaaaaaaagaagttaaacatactcatatataaccaatgagtcaaagaagaaatcataagttagaaaacgctttgagatgaatgcaaattatgacacaatataccaaaatatgccaatatactaatataccctagtttatgggatgaaactaggctgggtgcggtgcctcacatctgtaatctcagcaatttgggaggctgaggcaggaggattgcttgagcccaggagtctgagaccagcctgggcagcatagtgagaccctgtctttaaaaaaaaaaatttaagtaaataaaaataaaatagaaactaaagcagtgctttgaaggaaacatatagctgtagacccctaaaaaaaaaaaaaaagaaaagaaaattaaacccaaagccatcaaaggaaggattaacaaagattagagcaaaaattaatgaagtggggaacagaaaaacatagagaaaatcagcgaaaccaaaagttggttctttgaaaaaaaaatcaacaaaattgatgaacatttacctaaatggactaagaaaaaagagaacgcactcaaattactaaaatcaaaaatgaaagaagggaaataaggactgactttacagaaataaaaaggattataagagaatacaatgaaaaactgcatatcaacaaattagataatttggatgaaatggaaaacaaatttttttttttttagacagaatcgcattctgtcacccaggctggactgcagtggtgtgatctcagctcactgcaacctctgcctcccagattcaagcaattcttctgcctcagcctcccaagtagctgggattacaggcatgtgccaccatgcccggctaatttttttgtacttttagtagagacgaggtttcaccatatttgccaggctggtctcgaactcctgaccttgtgatccacccacctcgacttcccaaggtgctgggattacagacgtgagccaccgcgcccggccagaaaaattcttaaaaaggcacaaactacaggaattgactcaagaagaaataggaactctgaagagagatgtaacaaatagtttgtgccagtagtcaataacttccaactaagaaaagcccaggactagatggtatcactggtgaattataccaacatttaaagaggaattaacaccaatccttctcaaattcttccaaaaaatagaagaggatataacacttccaaactcattctgtgaggcgagcattaccctaatactaaagccagacaaagatactacaaggaaagaaaagtacagcccaatattccttatgcatattgatgcaaaaatcttcaacaaaataccagcagctgaattcaacggcatattaagaggattatacaccatgaccaagtgatttattcctggaatgcaaggatgattcaacacatgaaaatcaatcaatttaatgcatcacgttaacaaagtatttgataataaaaccagatgaagatataaaaggcgcagtggctcatgcctgtaatcctagcactttgggaggcagaggcgggagaactgtttcaacctgaaagttcgtgaccagcctgggcaacatagcaagacctcgtctctacaaaaagaaaaagaaaaagaaaatcatatctcttatgaacataagcataaaaatcctcaacaaaatactagcaaactgaatctggcagtatataaaaagattattctccattacaaagtggaatttaccaagggatgcaaggttggcttaacgtctgaaaaatcaataatgcgatacactatatcaatagagtaaaaaacaaaaagcaaaacaatcatttcaacagatgcagaaaaaagcatttgacaaaattcaacacctcttcatgataaaataaataaataaacttagaaatagaaggaaacattctcatcttgacaaggagtgtctatgaaaaaatccacagctaacatcatacttaatagtgaaaaactgaatgcttttctcttaagttcaggaaaaaggcaaaaatgtccactctcaacacttctcttcaacattgtactggaagttctagccagggcaagtaagcaaggaaatgaaataaaacacatacagattggaaaagaaaaagaaaaactatatttgcaggtgacataatttcatacacagaaaatcctaaggaatttactaaaaactattagaactaataaatgaggctgggcacagtggcccacgcctgtaatctcagcactttgggcggccaaggtgtgtggatcacttgaggtcagcagttcgagaccagcctggccaacgtggtgaaatcccatctctactgaaaatgcaaaaattagcttggtgtggtgccacaaacctgtaatatcagctactcaggaggctgaagcaggagaattgtttgaacccgggaggcgaaggttgcagtgagccaagatcgcgccactgcaatctggcccgagcaacagagcaagacactgtctcaaaaaaaaaaaaaaaaaaaagaacaacatgtctagaaataaacttaacaaaaggagtgcaagatttatacactaaaaacaaaacattattgaaagaagcacgggaaagacattctgtgttcatgaattggaagactaatactgttaaaatgacaataatctccaaactagctaagatagatgcaatctctatcaaaatccaaggtaccttttctttccagaaattgacaggctgatcctaaaattaatatggaaattcaaatgacccagaatagtcttgaaaaacaaagttggaggactcacagttccccatttcaaaacttactacaaagctacagtaatcaagacagtgtggtcctagcataaggatagacatagatcaatggaatcgatttaacagtccagaaataaaccttgtagtttacagtcaatcgattttcaacaagagtgttgtcttactccattcaggctgctataacaaaatgccataaactgggtagcttataaacaacaaaaatttatttctcacagttctaaaggctaggaagtccacagtgaaggtgctggtagatttgtcagaacccactttctggttcataaatggcgctttctcactatgttctcatgtggaagggtctagctacctctctggggtctcttttataagagcactaaactcccaaaggtcctacctcctaatactatcacttcattaggatttcaacatatggcttggggacgaaggagacacgaatattcagaccatagcaagtatcaagacaattcaatggggaaagaatagtcttttcaacaaatgatgctgggacaactggatattcacatgcaaaagaatgaaacaggacccctactacataccatatataaaaatgaaaatgggccaggcacggtgggtgactcatgcctgtaatcccagtgctttgagaggccaaggtggaaggatcgcttgggcccaggagttcaagaccagcctgcacaacatagctagaccccatccctacaaaaaatgataataaaaattagccaggtgtggtggcacacacttgtagtcctagtctcagctactcaggagggtgaggtgggaggattgcttgagcccaggagttagaggctgcagtgagctttcatcatgccactatgctctagcctgggcagcagagtgagagaactcatcccccccacccccaaaataaaaattaataaaaatttcaatggacgggcttgatggttcatgcctgtactcccagaactttgggaggccaaggcaggaggatcgcttgagctcaggagttcaagaccagcctcggcaacatattgaaaccttgtctctacaaaaaattgtacaaattagccaggtatggtggtgcacacctgtagtcccagttacttgggagggtgaggtgagaggatcacttgagcccaggaggttgaggctgctgtaagccgtgatcacaccactgcactccagcctaggtgacagagtgagaccctgtctctcaaagaaaaaaaaaaaattaaaatgaatcaaagaccttaatgtaagaactaaaatttaaaaacagaagaaaacaagagtaaaccttcatgaccatgtattaagcaatgaattattagatgtgacaccaaaggcacaagcaagaaaagaaaaaacagataaattggacttcattagaatttttgttccttataggataccagcaataaagtgagaagacatcccacagagtcggggagaaatatttacaaatcatatatctaataagagacttataaatgaaaatgtatgaaaaactcttacaactcaaaaataaaaagcaaaataactcaatttttaaaaaggggaaaagatctgaatagacatttctctaaggaagatagacaagtggccaatgagcttatgaaaagatgctcaataccattgggccatcagggaaatgcaaatcaaaactacagtgagataccactttatacccactagaatggctataataaaaaaaagaaatataataacaagagttggcaagaatgtagaggcattagaacactcgttcacaactgctggtaatgtaaaatggtgcaaccatttaggaaaatagtttggcagttccccaaatgttcaaaatagttaccatatgacccagcaattccacccctctcaaactaggtatctacccaagagaaatgaaagtatatatccacagaaaaccttgtacatgaatgctcacagcagcactcatcataatagtcaaagaatggaaatacccaaatatccatcaatggataaatgaataaataaaatgtagtatatccatacaagggaatattattctgcaatataaaggaattaagggccgggcgcagtggttcacacctgtaatcttagcactttgggaggctgaggtaggtggatcacctgaggtcaggagttcgagaccagcctggacaacatgttgaatccctgtctctactaaaaatacaaaaattagctgggcgtggtggtatgtgtctgtaatcccagctactcagaagactgagacaagagaatctcttgaacccaggaagcagaggttgcagtgagctgagattgcaccactgcactccagcctgggtgacagagcaagactccgtgttaaaaaaataaaaaataaaaataaaggaatgaagttctgatacatgctacaacacggattaaccttgaaaacatgatactaagtgaaggaagccagtcacaaaaaaaaacacatatcgtatgattccaattttatgaaatgttcagaatagagaaatctatagagacagaaagtagatttagtactgtcctggggctggaagaattaggaaggaaatgaaaagtaatcactaatgggtatggagtttctttctgaggcagtgaaaatgttctaaaattagatagttgtgatagttgcacatatgtgaaatactgaaagccattgaattgtacattttaaaaatgtcaattgtggcctggcgcagtggctcacacctgtaatcccagcattttgggaggccgaggtgggaggatcacctgaggttaggagtttgagaccagcctgaccaacatggagaaaccccatctctactaaaaatacaaaattagcagggcgtggtggtgtactcctgtaatcccagctacttgggagtctgaggcaggagaatcgcttgaacccgggaggcggaggttgcagtgagcgagatcgcaccattgcacgcgagcctgggcaacaagagtgaaactccgtctcaaaaaaaaaaaaaaaagtcaattgaaagatatgtgaattatatgtcagtaaagctgttttttaaataaatctttgtggtggctggtatggaaaagaaactggaggaggtgaaactggaggtcacagaagtgactggtgcatggtccaagcaggagaagatgaggcctgagctggaataggatttgtggactggattcaagagagattcaggatagaggtaggccaagacttggtgtcaattcatttttggcatgattcctggttccatagtgtcttgatccattttgtgttgctatcaagaaatacctggctgggcgcagtggctcatacctgtaatcccagcacttcgggaggccaggcattcgagaccaacctgactaacatggcaaaaccccacctctactaaaaaaaaaaaaatacaaaaaattagctgggcgtggtggcatgcacttgtaatcccagctaaatgggaggc[137 bp omitted]aaagaaatgatgtttatttagctcatggctctgcaggctgggaagtctgagaagcatggtgtcagcatctgctgggtttctggtgagggccttgtgctaggtcaaaacgtggcagagaaggtcaaaggggaagcagacgtggggaaagagagaaacctgaggggcatcctggctttataacaagccacttgtgtgggaactaatcctgtcctgccagagtgagaactcactatcccgaaaacggcaccaagccattcatgagcaatccgcccccatgactcaaaacacctcccacgaggccccacctcccaacaccaccactttgggaatcaaatttcaatgtgagttttggtggggacaaacaaaccataaaaaccatagcacatagtggctgtcctgacactaccagagtctgtatccatgcactgctctccatctccacaactattgcactaatccaagccattgtcatcactcatgtcaactactgcccttttggatgatctacctgcatcgactcatgttccctgccaatctattctctacactgaagccacaatggtcttcccacactgtaagtctgatcatgtccttcctgtgctttaaactcttcaatgatttccctttgcacctagaataaagaccaaaattcttgacccacttaactgtccctgtatgtcctggcccctgcctacctctcttacctctcccttactctctgtactctaagtacactgcactgctttcaaatgcctcacctaccacaggatctttgcacatgctgtcctcgctatggaatgcttccatctctgcttcacctgttgactccaactcttctctcagtcatcacctcaatcatcatttcttcctggaagccttccctgatggctccagttcccctacttttttttttttttttttttttgatacagactctcactgtgttgcccaggccggagtgcagtgacgcaatctcagctcactgcaatctctgcttcctgagttcaagcgattctcctcccttagcctcccaagtagctgggattacaagcgcccaccatcacacccggctaatttttgtatttttagtagagatggggtttcatcatg[137 bp omitted]tcacggcccttatcacagttgcagtttcacctttatttattgtatcgtttgattattgtctgtgtctctccttaggtcataagccccataagaacaatatctgtggccattttgttgaacgttgtatctctgatgcctaagacaccatttggcacatagcagatcctgaattatatttgttaaagaaatgaattaacctcagggacgattttaaatgctaattaaagcaacaatgatctatcctattgtgctcatagattggcaaagattaaaaagattgaaaatacttagcctgggcaagcgttgaagaaaatgagcactcccatacgccgggtggtgggtgtgtaggccaattggaccttcatatgttcacattgtttgaccctgcaattccacctatgagactttgttccaagaaaacgatcactcgtgcataatgatatacacaggaagatgtttagtgaagcaccatttgtaataagagaaagttggaaacaacctaaatcttcaacaataggatatggcatggcatagtggctcacacttgtaatcccagcagtttgggagactgaggtaggagaatcccatgaggccaggagtttgagaccagcctggccaacacagcgagactccatctctacaaaataattttttttttgagatggagtctcctctgtctcctcccaggctggagtgcagtggtgcaatcttggctcactgcaacctctgcctcccaagttcaagcgattctgttgcctcagcctccagagtagctgggactacaggcatgtgccactacgcccgggtaagttttatatttttagtagagaagaggtttcaccacagtggtcaggctgctctcgaactcctgaccttgtgatctgcctgcctcggccttccaaagtgctgagattacaggcgtgagccactgtgcctggccaaaagaatttatttttatttacttatttatttatttatttatttttgtggagatgaggcctactatgttgcccaggctggtctcaaactctcttaagctcaagtgatcctcatgcctcagccttccaaagtgctgggattacaggtatgagccgctgtgcctggcctacacattttttttttaattagctggggctgagctcggtggctcaggactgtaatcccagcactttgggaggccaaggagagtggatcatctaaagtcagaagttcgagaccagcctggccaacatggtgaaaccctgtctctactaaaactacaaaaattagccggacatgctggtgggtgtctgtaatcccagctactcaggaggctgaggcaggagaatcacttgaattcgagaggcagaggttgcagtgagccgagatgaggccactgcacttcagcctaggagacagatcaaaacactgtgtcaaaaaaaaaaaaaaattagctgggcatggtggcatgtgcctgtagttgtagctcctcaggaggctgaagcaggaggatctcttgagcccaggagttcaaggctgcagtgagtgccactgcactccagcctgagtggcagaaaaagaccttgtctcaaaaaataaaaataaaaaataaaaaattaggatattagttgtattaggccattcttgtgttgctataaagaaatacctggaactgggtaatttatataaaaaaaaagaggtcttattggctcacaattctgcaggctgtacaggaagtgtggcactggcatctgctaggctttgggaaagctttagggagcattttaactcgtggaaaaaggcaaagtgggagcaggtgtctcacatggcgggagcaggagtgaggaaatagaaagggcaggggaaggtgccacactttacaacaaccagatcttgtgagaactcactatcacgaggacagcaccaagccatgaagggatccaccccataacccaaataccccaccaggccccacctccaacattggggattaaaattcaacataagatttgggtgg[143 bp omitted]aaccctgtctctactaaaaatacaaaaaatgagccagacgtggtggcatgcacctgtagtcccagctgctcgggaggctaaggcaggagaatcccttgaaccttggaggcggaggttgttgcagtgagccgagatcacaccactgcactccagcctggtgacagcgcgagactgcatctcaataaataaataaataaataaataaatcgtggtgcattcatacaatagaatactgtgtggcctttaaaaatgataatgtaaattgtatttattgatgtgattagatgttcatgatagaatctttagtaaaaataggcagttactaaaaagtatgatggggccaggcgcagtgtctcacgccagtaatcccagcattttcagaggccaaggcgggcagatcacctgaggtcaagagttcgaaaccagagctggccaacatggtgaaaccctgtctctaataaaaatacaaaaattagccaggtgtgatggtgggtgcctgtaatcccagttactcaggaggctgaggcaggagactcgcttgaacccaggagggggaggttgcagtgagccaagatcgcaccactacactccagcctggcaacagagcaagactccatctcaaaaaaaaaaaaaaaaatttttttaaagtatgatagtaagatactaggtcttctattttaatagtatgtaatattgatatataaatgcataaaaaaactgcaaggataaatacaaagctatttactatgagttgttttggaggtccttaatattttactctacatgattctatatcatcttaaaattttgcgaggccatggtgatacacacctgtaatcccagctgcttgggaagctatggtgggaggattgcttgagcccaggagttcgaaaccagtctgggcaacaatagcaagacccacccccctcttaattaaaatattttttaaagtattttatgaagatgtactcataagctgggcgcagcggctcacgcctggaatcccagcagtttgggaggctgaggcaggcagatcacctgaggtcagaagttcgagaccagcctgaccaacatggagaaaccctgtctctactaaaaatacaaaaaattagcccggtgtggtggagcatgcctgtaatcctagctactcaggaggctgaggcaggagaatcccttgaacccaggaggcgggggttgtggtgagccgagatcgcgccattgcactccagcctgggcaacaagagcaaaactccgtctcaaaaaaaaaaaaaaagaaagaaagaaagaaaatgtactcaggtatcattgcataattgaagaagttttaaatcaaaaaaaggaaaagatagaataccaatagtaaatatgtgtatatgaccatacgtatatgtgctgtaggtaaatatacatataagaaggatcagccaggcacggtggctcacacctgtaatcccagcactttgggaggccaaggcaggtggatcatctgaggtcaggagttcgagaccagcctggccaacatggtgaaaccccatctctactaaaaatacaaaaaatagccaggtgtggtgacacatgcctgtaatcccagctactagggggtgctgaggcaggagaattgcttgaacccgggaggcggaggttgcagtgagctgagattgcgccactgcactccagcctgggcaacagagcgagacttgtctcaaaaaaaaaaaaaaaaagcatctggccaggagcagtggctcacccctgtaatcccagcactttgagaggccgagtcaggcggatcacttgaggccaggagttgaagaccagcctggccaacatggtgagacttcgtgtctactaaaaatacaaaagaaactagccaagcatggtggtacgtgcctgtagtcccagctactctggaggctgaggcaggagaatcacttgaacccgggaagcagaggttgcagttacctgagatcacaccacagcatgccagcctgggtgacagcaagatcctgtctcaaaacaaaacaaaacaaaacaaaaacaaacaaaaaaaaacaactaatatgaagctcttaacagtagttgttctggattggaggattatggatgatctttatgctccctttttgcctgtctatattttctataattagcatatattacttttgtaataagagaatgtaatcaagtatatttcattttgagaaaacattacagtgagaaataaaggccaggagagaaggactactcatgctggctagccagcccattatctctcagtaaagcacacctacgtgggaggccacattttaatcaagaagttgcttagtgaccacagaaccagagcaaagtgcctagctggatggctctaatgtcgaaagacagcaagcaatgatagcctgatgtatcatctccactgcagtgctaacctgcctgccctgaatgcagactttaaaacaccccaacacacctaaagcaccaagaacctgccctaagattgtttgatcgcattgccctggatcttccttgcttgtgtatgacttacattcgcctgactgtgtctctggctgacaataaactctcagcttcatagcctagctttgcatccgtttgtggtctggtgtctgactctttgttttagcatttgcccttggtctccttgaggcttaatttgcagcttctctctaatgaatttcagtttggacttgctccttgactcatcctgctaagctcctctagttgcaggagcccgggtaggggccctgcctctccttgttccactgctgggcaggggtaggacgtggggattcagacttacacctgacaaggctaacttcagacacattttttctttagcttataactttcagttaacttacgatcaattcttttttttttttttttaagacggagtctcgctctgtcacccaggctgcagtgcagtggcgcaatctcggctcactgcaagctccgcctcccgggttcacgccattccc[136 bp omitted]tgctgggattacaagcatgagccaccgcgcctggcctttttttttttttgaaacagagtcttgctctgttgcccaggctggagtgcagtggcgcgatcttggctcactgcaacctccgcctcccgggttcaagcaattctcctgcctcagtctcccaactaagctgggactacaggtgcacgccacaacacccagctaatttttgtatttttagtagagacgaggtttcacca[138 bp omitted]catctgtaatcccagcactttgggaagccgaggagagcagatcacctgaggtcaggagttcgagaccagcctggccaacatggcaaaaatccatctctactaaaaatacaaaaattagctgggcgtggtggcactcgcctgtaatcccagctacttgggaggctgagacacgagaatcgcttaaacccaggaggcggagattgcagtgagccacgaagaaagtgcagttatgatggggaagagggagaaaccagtggctgaagaggggcataatggggttgaggtgggggagtgttggttttgtttttcaatagtctggagcaggctttgaggcaagctagtttcaaagcagcctagggtggtggaaagggcttgagtttttcctcatcttgaccatgacaagctttcctcagcttgatctcatctccgccaggtggcagggcagcgagagccctggctcaggagccagactgcctccgctcttagcccagctccacactccacagcgtgactttagcccagttatttgtgcctcagtcttctttcaaatgggcataataagggtacatactccataggattgtcgacctaaaaagaagcagcttgggcaaaattaatgtaagtagagagtttatgtgggccaagcttgaagattgcaacctgagagcagaaagtcaagtttccctgaatgtacacttcaattactagcagttacaggtggagttttgaaggcaaaagtaggggacaaggagtggactgatgcaaagttgtttgtcaggaattctcattgatttacagaaataacattgttaagctacagactgtgggttgtagtgtctggtgtggcattattgggttaatttatagctatttatggcaatagcaagcaatttcaagagatgaatacacagttcaaagtggggagtagggcctgatttcagtctcattttaatgtctctcccggcctgacctgcattcctcagataaaaattcttttctcgggatcattgtaagaagggagatagctcccagcctgggcaacatggcgaaacgccgtctctacaaaaaatactaaaaaatgagccaggcatagtggcaagtgtctgtggtcccagctactcgggaggctgaggtgggtggattacttgagtccaagaggcagaggttgcagtgatctgagatcgcacccctgcacgccagcctgggagacagagtgagaccctgtctcaaaaaaaaaaaaaaattgctcatgcaaagatgcaaagtacttagaactgtggttgcctggcatggcacatagtaagtacctgctaggtgtgaaccgctattgttgttgctagctatgtggccttgggcatgtcacttaacctctcactttgtcattcaacctctcatttaacttctcatcattcatcacttgattaaggattcaaagtgcctttgcccgtactaggtattcagcaacactcagttcccttggttctttatatggtaataatagtattttacatatgaacacttactacactccaggcagctcatctattaccttcatcatcctagttaattatcaagacaaccatatgaggaagtgacattcggaagcaggtatccctagtttacagatgaggaaaccagggtcaaatagattgcgattggcccaagggcgtatacgaaatggctgagctgagattttacaatcctatttctttttcaaatactgacactggagtgggtgatgaccagttgttactaaatccagtggctaatcctttattgctacatggtttaaaccgattgttgctgctagctgatgatgaaaggctttgtagccttcctccgagtgggaacactttgctgcccccttgtgactcaccaagtttctgcctccaggttccccgttatttgaaaaaataaacaaataaataaaaggcccggtgctgcgacacacgcctgtaatcccagtactttgggaggccgaggcaggcggatcatgagatcaggagttcgagaccagcctggccaacacagtgaaaccctgtctctaataaaaatacaaaaattagctgggcgtggtggcacgcacctgtagtcccagctacttgagaggctgaggcaggagaattgcttgaacccgggaggtggagggtgcagtgagctgagattgcaccactgcactccagcctagcaacacagcgagactctgtctcaaaaaaaacttttttttaaaattaactatcttttctggtacagtaatttccctccagaaaaggtgttgaggtgttgcctgggagaggcaagggaaacatgattggagttgaattttgttttgttttgttttgttttaatatagaggagaaaatataggtgtctctcttttttattctttctttcttttttttttttttttttttttttgagatggagttttgctcttgttgcccaggctggagtgcaatggtgcgatcttggctcactgcaacctccacctcctgggttcaagcgattctcctgcctcagcctcctgagtagctgggattacaggcatgcgccaccatgcccagctaattttgtacttttagtagagacggggtttttccatgttcgtcaggctggtctcaaactcccgacctcaggtgatccgcccacctcagcctcccaaagtgctgggattacagacatgagccaccgtgcccggcctaaatataggtgtctcttacagcaactaggggcttcacaaaggtggcgacagtgggctctggtcttgagggatgactaaaagttttccaggcaggctaggaaggggaaggacattctgagcagagggaacagcatgggcaaaagcacggagatgtgatggagcatctcgggattttaagcgaggagagcaacatgcttagattcattcattctctgattcaacacatatgtgtcacatactgtgctgggtggtgacaatgacggtagtgaaaaacaccaagtccctaaaattatggagcttactttctagggaggtagatttgaagcaaatgcaagtacgagatgcctctggataaaaacaaagcaggggatgggaacagagagggaccagagggtgttattttcaacagggtggtcagggaggccttccctgagcaggtgacattggagcaggactgaatgaagtgggggagcctgcttcatgagtgaactgggaaagatcacacgaggcagagggaactacaggtgcaaaggccctgaggtgggagagtgttcggtgtgatcaaggagccagaggcggggtggtggaggactggagcatcctcagtgcaggtcggggtggggatgaagttggtaggagagggaggaggtgagattgcagaagactcagtcatgttttcatggaggaccttgtgagccatggcaaggagtggggatctcattctaagaagggcaggaagtgtttgctgagactgtgttgagatgtgagaggaaagagaggcatttagatggctggcagattttcacccaagcaactaggaagacttcactatggatgggctaagtttgagaagcttattagagctccaaggggagctgtcagcaggctgctggacagcagctggatctgtgtgtctggaattcagaggaaggatcggagcagcaggcgtctgtgcagaggggtcattgaaagacctggatgagatgagattctcaagggagcgagtacatagagacaagtggacgaggtccgagccccatggctccccaatctccagactctagaggatggagccagcaggaccagcagaaggaaggcactgaggaatgactgactggctagggagctcaaaggaaaaccaggagagctgggtgtcccagaagccaagggaagcaggagttgcaaggaggatggggtgatcgacaatgtccaatgctgctgagagggtccagtaaggtgaggactcagacccaactgctggatttgacagcataaagggagggcatggatgaccttggtacactctagcttcatgggcatgtgatctgtgtagtgggacagggccccactcttagcagggtcctgcaattggtctaatgcacttctgagaccctgttgaatttttttttttttaagacagagtctcactctgtcgcccaggccggagtgcagtggagcaatctcagctcactgcaacctccgcctcccaggttcaagcgattctcccgcctcagcctcctgagtagctgggattacaggcatgtgccaccagacccagctaatttttgtatttttggtagagacagggtt[132 bp omitted]tgagttgaatatggaacctctctcaaaacatatatccatccagaatgtgaccttatttggaaaaggggtctttgcagatgtaattaaggtaaaaatgttatgacgagattgtattggattagggcaagccctaaatccaatgacaggtgtcctaataagggaaaagaaagggaaaagacacagagaggtgacataaagacataggcagaggccgggcaccgtggctcacacctgtattcccaccactttgggagactg[134 bp omitted]tgaggcaggagaatgaagtgaacccgggaggtggagcttgcagtgagccaagatcgtgccactacactacagcctgggtgaatccatctcaaaaacaaaaacaaaaacaaaaaacaaaaaacaaaaacaaaacaaaaaaaaaattagctggacgtggtggcacatgcctgtaatcacagctactcggggggctgagacaggagaatcacttgaaccctggaggcgaaggttgcagtgaactgagatcgcgccactgcgctccagtctgggcgacagagtgagactttgtctcgaaaaaaaaaaaaagacaaaggcagagattggagtgatgcatctacaagccaaggagcatgaaggattgcttgcagccatcagaagcttgaaaggaggccgggtgtggtggctcacgcctataatcccagcactttgagaggccaaggcgggtggatcacttgaggtcaagagttcgaggccagtctggccaatatggtgaaaccctgtctttactaaaaatacaaaaattagctgggcgtgacagcgcatgcctgtaatcccagctcttcaggacgctgaggcaggagaatcgcttgaagctgggaggcggaggttgcagtgagccgagatcctgccattgcaccccagcctgggtgagagaaagactctgtcgcaaaaaagaaaaaaaaaaagaggccggatgcagtggctcacgcctgtaatcccagccctttgggaggcc[136 bp omitted]gaggcaggagaatggcatgaactggggaggtggatcttgcagtaagccgagatcgcacccgtgccactgcactccagcctgggtgacagagcgagaccacgtcttaaaaaaaaaaaaaaaaggccgggcgcagtggtaatcccagcactttgggaggcctagacaggcggatcacgaggtcaggagatccagaccatcctggctaacacggtgaaaccccgtctctactgaaagtacaaaacaattagccgggcgtgg[135 bp omitted]caaaaaaaaaaagtgttcacatccaagttctcatttgatccttccaaaaggcctatgaggtaataaagtaattcctttcatgtccatttttcagatgacaaaatggaggttcagagaggttaagtaatcactcaaggtcacacagccagtgaccagcagacctagaactccgatcacaataagatctttacccctcttcgtggctgcccattttagccagcttttttttttttttttttttttagacgaagtctcactctagcccaggcaggagtgcagtggcataacctcagctcactgcaacctccacctcccgggttcaagcaattctcgttcctcagcctccctagtagctgggattacagacacacagcatcacgcccagctaattgttgtatttttagtagagacggggtttcactatgttggccaggctggaacttttggcctcaagtgatctgcttgccttggcctccaaaagtgctgggatcacaggtgtgagccacctcacccagcctttagccagcttttgacgcacaacgagtgggggtagcaaattcttgggcatgtccgcttacaaatgtggaacccaatgtttctatgtggggtggtggtggggaggtggctgctcctctagcaacagtgatccaggccagcccttggcaggacttcctcaccagagtcggctgcaaagccagccagctggcagccggccaggctcatagagtgaacccacttggagccgagagccccacagagggcacagcaggggcatgaggtccaacaaactcaggctgtgtgtgcttctgccccagagaatacaacggcactgggagagacagcagccacagcttcccgagaagcactggaatcctaggagcggctgccgggcaggggcaggcaaggcagacagatggaagagtgcccaggctgcatcatggtagcagtttgaggttctgttgaaggagggaagtgacaagctgggctgagtgacaggcatggatgagagggcagaccaggctctggagaaaacagcacatgaacccatctttagtgacagtgaactgagcagagaaatgtcactttcaggcctggaaatggccagggaggcataatagtgactcctgcagggggcttctcctcaaccgggagctgggcgtccagggcaaggtggccaggcttgtgccatctcaactacttgggaacaaatagacttggcactctatgtttagccaccaaagtcaagaccaggagccccgaagtcccatcccccaaggagctgaggagcccagatgctagaaagagggccacaggatgagcagggccagcagctgcctggcaggacatctgtcacagcccattgggcagcaaccaagaggagtgcggaggctacgcggccccatttgctgaaggggagggctgcagactgctcatctgggagagggacagatgaacccagagccagccaaggaggtcacagcccagtcagatcacaaaacaaaacaaaccaaacccagctctcattaactgaagcttggcacatgctgggcattgtgtgatgtgctgtctttggaagagctgccttaattcgtaggatagctaaagtgtaattattatgtgattacaccttattatgtaattattagacagaacccacttggagctgagagccccacagagggcacagcaggggcgtgaggtccaacaagctcaggctgtgtgtgcttctggcccagagaagacgacagcgctgggagagacagcagccacagtttctctagaaacactagaatcccaggagcagctgctgggcaggggcagatgagggggcaggtgtcattatcatgacctccactttatagatggggaagctcaggtacaaagaagtaaagtgccttatataagtcacgtagttaagtcttcaggctgagattcaaaccaggtctgtctaactttaaagcctgttttgttcactctccctggcagggctattataaccattacatgaaataaaatatgatattagtaatagtgaaggcagccgggcatggtggctcacgcctgtaatcccagctaagatgggcggatcacgaggtcaggagatccagaccatcctggccaacatggtgaaaccccatccctactaacttacaaaaaaaaaaaaaaaaaaaattagccaagcatggtggcgcagtcctgcagtcccagccactcaggaggctcagtgaggcaggggaatcgcttgaacccgggaggcagaggttgcagtgagccaatattgcaccattgcattccagcctggcgacagagcaagactctgtgtcaaataaataaataatagtgaaggccaggtgcggtgcctcacgagtgtaatcccagcactttgggaggctgaggcaggcggatcatttgagatcaggagttcaagagcagcctggacaacatggcgaaaccccatctctactaaaaatacataacttagccggaccccaggaggtggagtttgcagtgggctgagatcgcaccaccgcactccagcctgagtgacagagcaagactctgtctcaagaaaataaaaaataaaaaaaagaaagaaatgggccaggtgcagtggctcacgtctgtaatcccagcactttgggaggctgaggcaggcagatcacttgaggccaggagttcaagaccagcctgggcaacatggtgaaaccccatctctactaaaaatataaaaattcactgggtgtggtcgcgggtgcctgtaatctcagctactcgggaggctgaggcgggagaatcccttgaacctggttggtggaggctgtagtgagccaagattgtgccactccactgcactccagcctgggtgacagagt[133 bp omitted]accctgtctctactaaaatacaaaaattagccgggcgtggtggcacgcgcctgtaatcccagctactaggctacttgggaggctgagggaggagaatcgcttgaatccgggaggtggaggttgcggtgagccgagatcgcaccattacactccagcctgagcaacaagatcgacactccgtctcaaaaaaaaaaaaaaaaaaaaaaagaatcttctaacctaaaagttggaaaagcccctagaagtgatgtactccaaccctcttttgtatgcaggaattcctccatgcagcctccaagaaaatactgatccagtctctgcttaagtatctccagtgatgaggaacttactatttcccaaagcagccatttacattttaagattcctatcatggttagatagctcttaatggaactgcgccaaaatctgcttctttgtcaatttcacccaggggaccaggctctgtgctgtgggaccacagagacgcacagtaatatcaactgtcaggtgctttgaagatttcaagcactctcctttttttttttcttttttttttgag[312 bp omitted]cacaacacacagtgaggaaggtattgtcctccccattgcaccaatgaagaaattgaggctcagggagacgagatgacttaccaaagggagcaggcctagtaaggtgcagaactgtgaattcagctgagggttcctgagtccaaagcccacactctttctacacctcctctcttccttgagtcccctccctctcccccatgggccagctcttcagttttttaaaggcagctctcatgttcctcatgagtcttctcctcctcagctaaacattcccagggctttcaaccatttcttatcaggagtcccatcactccaaaagctggatgggctccagaaactgagcacaatattccaggtggagtctggccggtcctgtgcagagcagacctcttgtgccctctcccctttgctctggacactgtactgccattcctgcagcctgtgttggtaggaatcaaattcctgtattggtaataaagtctcatcaatctgtcgacttacttatttttcactcataaatatgaataatttgcatgtaagtttggtctcttgttcctttgcaaaatcttcagtccccaggagccctgagaaacaagtgttatatgagcacagaaggagatgcatgaggcagcccggacacttaattatactttgaaatgtgtggagaagtgtgaaacctacccagcttgctagatcaggcatgtgggccctatctgtctttggaaggagtgcatcctccctctggatctcgatgaatgaaaccaagttgagttattgcatccgcatggatttccagcagctctgagcgtctggcagacaggaaacaaatcaagtgactattcttcccagaccgctcttgccaaactggctgtcaggggccataggaacagaactcctcatgatgccagctggccaagtgaaacagtggccaggggtagattcttccctgcaccttaagggagatgccaaacttccaaaaaaatgggaaccaccttgtgataggcactgctgagcggcaggtttcagggtcttagtatacccagtaggcagctcaactgtcctggcgaggccaggcagggctctcatgcagagatggtgtgcaaatccgttaacaatggcaccaggaccagctgcaatgctctctctccctgctgtttgtgggcaccattggccacccactgaatgaactgacccatggatagtgtcttcttttttttttttttgagatggagtttcaatcttgtttcccaggttggagtgcaaggcacgatcttggctcactgcaacctctgcctcccaggttcaagcgattctcctgtctcagcctcccgagtagccgggattacaggcgcatgccaccatgcccggctaatttttgtatttttggtagagatggggtttc[133 bp omitted]tcagcttgagatcccccttgtaccctctaccaacctgcacaaaacccccagcacatcaaagggaccacactgttagcaaactaattgtgagagactgcccacacctgccttgataagtggaaacagaaacagggtttggccacagaatgcacaggtgacaatgaaagactcagtgccagaaaaggcacaggccctttttcttgat[186 bp omitted]gtg[132 bp omitted]caaaaaaaaaaaaaaaaaaaaagcaactgacaatgtttcatattgaaatctctccagactctgcccattttaagtgtgaacaatgttcacatgaacccagcccatataagagtcactcaaatatggaggctgacaattgacaaatagcaccaacctggaggcttcaggtaattt[142 bp omitted]gaaatcccatctctattagaaaaacaattaaaaaaaacaaaaaattagccgggcgtggtggcaggtgcctgtagtcacagctacttgggaggctgaggcaggagaatcacttgaacccaggaggtggaggttgcagcaagccgagatcgcaccactgcactccagcctgggcagcagagtgaaccaccgtctcaaaacaaacaaacaaacaaacaaacaaacaaacaaaaaaggcctggtgtagtggctcacacctgtaatctcagcactttgagaggtcaaggtgggcagatcatgaggtcaggagttcaagaccagcctggccaacatagtgtaaccccgtctctactaaaaagtataaaaattagcctggcatggtggtgcatacctgtagtcccagctactagggaggctgaggcaggagaatcgcttgaacctgggaggcggaggttgtggtgagctgagatcacgtcactgcactccagcctgggcaacagagtgagactctatctcaaaaaaaaaaaaagactattttcccttgtttatttcacacaagaggggccaccatgaaacgtaaggctcagatggcagagttgagtgtgctaccaggaaaagtctccaagataagaatcctcactactatcaggctccctcatgtctgagatccctaccattagaaccactcctttgggttaaggcattgaaggccccaatcacaagacaaatatttcagtgtatgagctattgactcaacatgtgactcttgagccacactgcctggggttgaatcccaactctaccagatactagttgtgcaatcttgagcaagtcacttaacctctcaaattctttgagccttaattttctcatctgtaaaatagaggtaataagggaacctacccataaggctattttgaggagtgatatgatttggctgtgtccccacccaaatctcatcttgaattgtacctcccacaattcccacgtgtcgtgggaagaacctggtgggaggtaattgaatcataggggcaggtgtttcccgtgctgttctcatgatagtgaataagtctcgtgagatctgatggttttaaaaatgtgagtttccctgcacaagctctcttctcctgtctgctgccatgtgagacatgcctttcaccttccaccatgattgtgaggcctccccagccatgtggaactgtaggtccattaaacctcttttttctttttctttcttttttttttttttttttagatggagtctcattctgtcacccaggctggagtgcagtggcgtgatcctggctcactacaacctccacctcccaggttcaagcaattctcctgcctcagcctcccaagtagctgagatcacaggcatgtaccaccatgccctactaatttttgtatttttagtagagatggggttttg[131 bp omitted]atgtctttatcagcagggtgaaaatggactaataaaaggaattaatagtacatataaatacaaatgagctaatgaattaatacatataatacatataaacttggagcagtagctggcacatagaaagctgttatcaggccgggcacagtggctcacgcctgtaatctcagcactttgggaggccgaggcgggcagatcacgaggtcaagagatggagaccatcttggccaacatggggaaacctcctctttactaaaaatacaaaaattagctgggcgtagcggcacacgcctgtaatcccagttactcaggagactgaggcatgataattgcttgaacctgggaagtggaggttgcagtgagccaagatagtgccagtgcattacagcctgggtgacagagggaagccctgtctcaaaaaaaataaaaaagaaaaaggccagg[174 bp omitted]tgaggca[137 bp omitted]ggaatcaggccgggtgcagtggctcatgcctgtaatcctagcactttgggaggccaaggcaggaggatcccttgaacccaggagtttaagacaaccctgggtgacatagtgagacccttgtctctacaaaacaatttaaaaattagccgggcctggtagctcaagcctatagacccagctactcgggaggctgagatttgaggattgcttgagcccaggaggttgaggctgcagtgagccatgatgtgtcactgcactccagcctgggtgacagagaaagaccctgtctcaaaaaaagaaaaaagaaatcagcaccccctaaccaaaaaaataaataaataaataaagcaaataccacaaaggcct[154 bp omitted]ctcccgagtagct[205 bp omitted]gcactttaagtggataatttgccttgagagattagctaataatagtacgaagccattaggattaatgagagctttaaaatctaagcctctacaaggtggatgcatcacgaaactacagtgggagacgtccagatgatggctgcttttcgtggcagtttggaagcatatccacaaattatttgacactcctccttttgagaggaggaatctatatgccattccctcgaatctgagcagccgacagagtatggtagaggagatgctgcctaacttccaaagctatgtcataaaccgcgggcagtggctgcctcaagtgtcctggccagcagccctcagctgaggtcccagccagcagccagcagcaaatgacagacatgtgaggaaatacatctccagaggatcccaccccaaccagtgtcaagtcacccccagctctcacatcttcccagtcaatgtgccagacatcatggagcggatgctagtcatccccttgtgccctgtctaaattcttgacctccagaattcatgagcataagaaaatagttatttttcaccactaagttttgggatgaggccgggcgcagtggctcatggctataatcctataatcccagcactttgggaggctgaggcatgtgcatcacctgaagtcaagagttcgacaccagcttttgcaacatggtgaaatctcgtctctactaaaaatacaaaaattagctgagtgtggtggcatgcacctgtagtcccagttacttgcagggctgaggtggggaggatcacttgaccccgggaagtggaggttgcagtgagccgagattttgccactgcactccatcctgggcaacagagcaagattctgtctcaaaaaaaaaaaaagttttaggatgattttttacacagcagtaggaactagaagggtagtggcagagaggggccacaaaagaggcttctgggtgctgtgatattctatgtcttgatctgggtgctagttacacaagtgtgttcaatttgtaatgaccagcctggccaacatggtaaaacctcgtctctactaaaaatacaaaaattagctgggcgtggtagcgggtgcctgtgatcccagctactcggaaggctgaggcaggagaatcgcttgaacccaggaggcagaggttgcagtaagccgagactgcaccattgcactccagcctggatgacaagagcaaaaactctgtctcaaaacaaagcaaaacagaaaaccgtgtcaagctatacacttatttgtgcatttttttatgcacgtcaccatattttaaaactttacattaacaaaccctggatatacagaacataaagacacgtctctgctattttttcagcaatgccaaaagtcatgtgattttcaaaacagtactttattagatctcactgaacggaaagacacatgtttagaagcttcattcgaagtttgttacttaataacaaaaaacaaaagttcatagatccccttgaggaagcagttgtttttactatcttagtaaacatggtcaaaatagttcatttgaaacaaagtggtaataaactctaacacatttatttgtcagtaaataccattggaaggcatctagctaacattgccgaagatttgaacaaactatgagtaaatgatacagtgtaggaagttttctgtacagttggacaaaactttttcagcattttcagctttgtatttgctagatactgtttcaataataaaatccacaaagaatttatttatttattttgagataagagtctccctctgtcacccaggctggagtatagtggcagcattgtagctcactgcagcctttaactcctgggctcaggcgatcctcccacttgagccttctgagtagctgggaccacaggcgcatgccaccactccaggctatttttattttttaattttttgtagtgacagggtctcgttttgttgcccaggcttatctcaaactcctggccacaagtgatactcccaccccagcctcccagagtgttcggattacaggtgtgagtcaccatgcccagccaaaaaactacttttttgtgtgtggtctaccaaaggagaaatgtaaaggagaagatatattatgaacacaaagtgacttgtttacttttgtaacatcttataggaaaactggaaataaagatttttacactgatgaagtgctactctgacaggaaactttccaaaagtgggggtggatttcaaggtaactttactgagaaagttggcgagctatcacagcaaagatattgaagcctgaaatgtacaaagtgctataggattcattaatctggttaacggtataaaaataagacttttttttttttggaaacagggtctcactctgttgccaaggctggagtacagtagcacaatgtcgggtcactgcaacctctgcctctgggttcaagtgattctcctgcctcagcctaccaaatagctgaaattacaggcacgtgccaccaagcccagctaatttttgtatttttagttgagacagggttactccttgttggccaggctggtctcaaactcccgacctcaaatgatctaccctcatcggcctcccaaagtgctgcggttacaggcatgagccaccgtgcctggcaaaataagacttgatatacagtaatttttttttttttttagacagtctcactctttcgcccaggctagagttcagtggtgtgatctcagctcactgcaacctccacctcccaggctcatgcaattctcctgcctcagtctcccaagtagctgggaccacaggtgcgtgtcaccaggcccggctttttttttttttttttttttgtatttttagtagagatgggggtttcaccatgttggccaggctggtctcaaactcctgacctcaggtgatcctccctccttggcctcccaaagtgctgggattacaggtgtgagccaccgtgcccagccaatataccagtaaaatctttaaagaattctattatgtaagtccttaaaagagttttcaaactaaaagatgcacttttttttccacataaagatacgcatttcaaatttactgacattttcaggggtgtcttagagtagtcagaagactttttttttttttttttgccgtgaggttttgctcttgttgtccaggctggagtgcaatggtgcaatctcggctcattgaaacttccgcctcccaggttcaagcgattctcctgcctcagcctcctgagtagctgggattacaggcacctgccaccatgcccagctaatttttttgtatttttagtagagacagagttttgccatgttggccagcctagtctcaaactcctggtctcaggtgatccgccagtctcggcatcccaaagtgctgggattacaggtgtgagccaccgcgcccagccaggagacttttaaaaaaaaatcataataaacacagcccatccagttcttcaagataaagttgatattttaacaatgagtgagaaagtaactgctttggaaggaaatgcagaacaggcagagaacatttggaaaatggatgtttgtgttttcattgttatgtaattttgtggccaaaaatgatgtaagtagcatacctagaaaacctatcatatctgcacattttaaaacttcagaataaaaattcctaacctgctttttaaacatatttcaaatgtagagttttttgtgggttttcggcacatttgttaaaaacacaaaggtgcaacaagtacttaccgttttgcaagaacaaatgattgccatcagcaaaaatgaccgtttaccaactgaatttcatcagaaacctttgcataattggtgggtggaattgaaaaacaagaattatgatgtactaagcccagccaattaaatttttcttccatttggagctgtgtatctttgtgagacatcttgcttatgtgtgacatccactaaaactgagtgctgcaataaagtaagatccgcaccttcaaagagctgcattatagtgttaacctaagaacggtcatagtagcctagcacttttttttttttttttttgagacggagtcttgctctggtgcccaggctagagtgcagtggcgaggtctcggctcactacacctccacctcctgagttcaagtgattctcctgcctcagcctcccgagtagctgggacaacaagcgtgtgccaccacacccagctaattttttatttttagtagagacggtttttcaacatgttggccaggctggtctcgaacttctgacatcaggtgattcacctgccttggcctcccaaagtgctgggattacaggtgtgagccaccgcacccagccagcactttctaataacaatgatgttagatttttaaaaaatggctaagtaaagtggctcacccctgtaattccagtactttgggaggccaaggtgagtagattgcttgagcccaggcgttcgagaccagcctgggcaacatggtgaaactcatctctacaaaaaatacaaaaattagcctggcatggtgacacacgcctgtagtcccagatacttgggggcctgggggtgaggatcacttgagcccaggaggttgaggttgcagtgagctgtattcttaacactgcactccagcctggggaacagagtgagaccctgtctcaaaaaaagaaaaaaaaaaagatgttttaaaaacgaagcatatgcaatcacattctcttgtgaaaaaattaataataaaattttaatgaatatccaaatagttttgtactacaagcattataaaactgtaaattattttaaactatattttatctttgtctcatccttttaaaatttcctttttgtgtatgctttataatatacatatttcatagagtaatacacacacatcattttgaaattgcaaaatattcacgaatgttgagaatatctgctcaaaatatttttattataggggcatgcaatttaaaacgttgggacaccagccttggcaatatggtg[137 bp omitted]cctgcctctactaaaaatcaaaaaaattagctgggcgtggtggtgggcacctgtaatcccagctactcgggaggctgaggcaggagaatcgcttgaacccggaaggtggaggttgcagtgagccaagatggcatcatggcactccagcctgggcaacaagagcgaaattctgtctcaaaaaacaaacaattagctgggcatggtggcacatgcctgtactcccagctactcaggaggctgaggtgggaggatggtttgagcccaggagttagaagctgcagtgagctatgatggtgccactgcactccagcctgggtgacacagccagattcccatctcaaaaaaaaaaaaattggagattattgctttaatatctaccataatgttaagcatcatgaatgtgatgtgattagcatagtgtttggcacatattaaggcctcaatgagtgttggcttttacaacatcctctatgtaaatgagggatgcattagacccagtgtaacatgatggttaaaagtatgagccttggaatcagttgaagctggatgggtttcctgccaattactagctgtgtgaacgtggtcaattaacttcattgggcctcagattctcattagtctcttagagttgttgtaaagattaagggacataatgcactttatggcaacagctttactgagctataattcacataccatacaattcacttttttttttaaacgaagtttagctttcgttgggcaggctggggtgtaatggtgtgatctcggctcactgcaacttccacttcccaggttcaagcgattttcctgcctcagcctcctgcgcagctgggattacaggcatgcaccaccaagcccggctaattttgtatttttagtagagatggggtttcatcaagttggccaggctggtcttgaactcctgagctcaggtgatctgcccacctcggcctcccaccgtgcttggattacagccatgagccactgcgcccagcaactcaccactttaaagtgtatatttcagtgctttttagtatattcacaaggctgtgcaaccatcaccgtgtctggaattggtgggtttttggtctcactgacttcaagaaggaagccgcggaccctcgcggtgagtgttacagctcttaaggtggcgcgtctggagtctgtcccttctgatgttcagatgtgtttggagtttttttcttctggtgggttcgtggtctcacttgctcaagagtgaagctgcagaccttcccggtgagtgttacagctcttacggcagcgcgtggggagttgttcattcctcccagtgggctcgtagtctcactgggctcaggcgtgaagctgcagattttggcggttaagtgttacagctcataaaagcagcgtggacctaaagagtaagcattagcaagatttattgcaaagagtgaaagaacaaagcttccacagtgtggtaagggacgggagcgggttgtcaatgctgcttcgggcagcctgcttttattctcttatctggccccacccacatcctgctgattggtagagcccagtggcctgtttggtcagggcgctgattggtgcgtttacaatccctgagctagatacaaaggttctccacgtccccatcagattagttagatacagagttttgacacacaggttctccaaggccccaccagagcagctagatacagagtgtcgattggtgcattcaaaaccttgagctaaacacagggtgctgattggtgtgtttacaaaccttgagctagatacagagtgccgattggtgtatttacaatccctgagctagacataaaggttctccaaggccccaccagagcagctagatacagagtgtcgattggtgcactcacaaaccttgagctaaacacagggtgctgattagtgtatttacaatccctcagctagacataaagactctccacttccccaccagactcaggagcccagctggcttcacctagtggatcccgcactggggccgcaggtggagctgcctgccagtcccgtgccgtgtgcttgcacttctcagcccttgggcggtcgatgggactgggcgccgtggagcagggggtggtgctcgtcggggaggctggggccgcacaggagcccatggagtgggtgggaggctcaggcatggcgggctgcaggtcccgagccctgccccgcgggaaggcagctaaggcccagcgagaaatccagcacagcgccggtgggccggcactgctgggggacccagtacaccctccacagccactggccactggcctgggtgctaagtccctcattgcccggggccggcagggccggccggctgctccgagtgcggggcccgccaagcccacgcccacccagaactccagctggcccgcaagcgctgcgcgcagccccggttcctgctcgcgcctctccctccacacctccctgcaagctgagggacctggttctggtcttggccagcccagaaaggggctccctcagtgcagcggcgggcggaaggactcctcaagtgccgccaaagtgggaacccaagcagaggaggcgccgagagcaagcgagggctctgaggactgccagcacgctgtcacctctcatcaccactatctaattccagaatattttcaacacccccaaagaaacccatacccattagcaatcattctctattctccctcttccctcatgcctgccttgacaaccactgacctactttctgtttgtatggatttgcctcgtctggacatctcctgtaggaatcagaagagtcttttgtgtctggttctttcacttagcatagtatttttcacattcctccatgttgtagcatgtgtcagttatttcgttccttattttttatttatttattttttttgagacggagtcttgctctgtcgcccaggctggcgtgcagtggcgcgatctcggcccactgcaagctccgccttcccggttcacgccattctcctgcttc[224 bp omitted]ggctggagggcagtggcgcaatcttggctcactgcaacctccgcctccagggttcaagcgattctcatgactcagcctcccaagtaagtgggattacaggcgcccaccaccacgcccagctaatttttggggtttgttgttgttgttgtttttgagatggagtctcgttctgtctcccaggctggagtgcagtggcacaatcttggctcactgcaaccttcacctcccaggttcaagcaattctcctgtctcagcctccagcatagctgggactgcaggcacgcaccaccatgcccggataatttttgtagttttagtagagatggtgttttaccatattggtcaggctggtctcaaactcctgacctcaggtgatccacccacctcggcatcccaaagtgctgggattaccggtgtgagccactgcatctggcaatttttgtattttcttttttcagtaaagacagggttttaccatg[136 bp omitted]atggatatactatggatatcgggattgtttctaccttttggctattgtaaatagttctgctgtgaccattcatgtatgaaaatgcatatttaatgcttggcacaggacctaagtcaccagccacctaagtgcttaatgaacagtaggcagctgtaatcactgttattacagagtgctacgttaggtgatctggggtacaggatgcctggatgtcagaaatagatggctgaaggcgccaaggacaacatttacccactgcacaattttattaagagctgttcctgtcagccgtacccaaatgtacagtatggcagcatcaaacagaggcatgagcacggaccctgctctaccactttcgagacgcgtgaccctgggcaggccacttaacctccctcagccttgtgtgtgaattgcatataaatactgtcttctctacatatctcacaagcttgctgtctgggtcaagagataattaaaaatatgaaagcactctgaaaactaagagtttattattccaagccttacgtatgacagaagccaactgataaagtaaggaaggaaccactttgtactgctcactggcctccccctctctcctgatggttcacattcctttcaagatgaggccagccccctcacccctagggctagtaccttcttcccagcaactacttaagggccaatgacctgctccagggtagaagcctgaattcatataaacaaagggcttattgctgggcgcagtagctcacgcctgtaaccccagcactttgggaggcagaggtgggtggatcacttgaggccaggagttcaagaccagcctggccaacacaggggaatgacatctctactaaaaatacaaaaattagctgggtgtggtggtacacacctgtaatcccagctactcgggagtctgaggcaagagaatcgcttgaacctgggaggcagaggttgcagtgagccgagatcgtgccactgcattccagcctgggtgacagagtgagactgtctcaaaacaaaacaaaacaaaacaaaacaaaagggcctgttgctgggcgcggtagctcatgcctgtaatcccagcactttgggaggctgaggtgggaggatcgcttgaccctaggagttcaagaccagcctgggcaacatagcgagaccctgtcctaaaaaaaaaaaaaattaaacaaagggcctgccatgcctctttcgttgcctacaggttgaaacagacacagcctttctacttttctcagttgctagttggtcagagcgccctcatgtgtctccatatggtaataccttaagtcttttacaggatgtggcattcttttaatctcagtatcaataaaatgtgtaatggaaatttttttctcgtcacacttcaaagcccatgcttgactctcaggctccaattaagccattccagcttgagtttaggcaggtttcctgcttccactcaggcctacagatttcttcctgctccctgcccacccctttctccttagtcatttttagaagccctggtgtcaacttggttctaccactttctactcttccaagctcagtaagctctcaaaataagattgtaagttctttttttaactggatacatcaggtcttactgcaggattggcgggggaggggggtgggaaggtgggggtaattccaaagtactaggaaataatttttaaagtgtttaccaaatatgacttgttccatagtctaaggaaaagggatccaaaatgagatctcatgtaaaggtctgacatttgggaaggggaaagtgatgtttggcagagtacatacacacagacacatacacattatacacacaaccagacagtgatgtctggtacacatacataccactcaaacatccattcttgcacacacattcacatgcaaacagagagaaaggagctctctctctttcataggtttctcattgagaatcatgatgatatcagcacaggtctttggaggaaaggaaatttacattctatatctggaaccccaagaatgttccagccgtgtgtggtggctcacaccaccgggtgtggtgggaggccaaggtgggtggatcacttggggccaggagttcgagaccagcctggccaacatggtaaaaccccgtctctactaaaaatacaaaatttagctgagaatggtggtgcacgtctgtaatcccagctactcaggaggctgaggcatgagaatcacttgaaccagagaggcggaggttgcagtgagccgagatcacaccacactgcactccagcctaggcaacagatgggactccgtctcaaaaaaaaagaaagaaagaaaaaaaaaagaatgttccccattccctccatgaccgagggttatggacgcctgagggactttacttcccatattccacacatctgcttctcaactgttttgcactcatggatttttctgaatccataagcccccggggcaaactccattgagagcccaaggatacaccagcatttggcttcgcccaaggagcatgtttctgagaagtttcatgtaaattaaatttttgcagatcaactatgatttcctactgacatcccctaagatttctgagctgctctcttcatcaagatagattttcagtgtacgcctaacacatcagcttctctgttcctctgccttctgccatgctccctgagttagttaaacctcatctggaaaataaaggccaatgaaacattaagatctcttctagttctttttttttttttttttttgagacggagtctcgctctgtcacccacactacagtgcagtggcgtgatctcagctcactgcaagctccacctcccgggttcacgccattctcctgcctcagcctcccgagtagctgggactacccaccacc[137 bp omitted]gcccagccgatctcttctagttctaatagtccaagatctagtaaataaacccacaaatatattagagaggctgctatttggaaaagacatcagtattattacaatttgcaatgcaaatatctactctacctccagctttttgggaagtcatttcccagggcttgaggggtttttgccccactcccttggaggggtagcagatgtttcagataactggcatgttaattttaggtgggtgggtactatcccttctgttttccactccctctgccctactccctgctatcaaattcctgagaccctctctactaaaatagagatgggtgttgcggttctggggagtggtgtgtgcagctggtgacctagggtagaaagcacttgctaattaaagatgaaacaagttgctagggaggcaccgtggctttggtctctagcagcagagttaagcaagggcacatgtatcatgggtctgtggcactggtcaggcggctgcctttgcaatctttgaactggaaacagatattattcatgctgatagggaagagagttgcctgcttagtggtgacgaaaattaatagtccaagcattcttccatcctgcattttccatgctggcattttgacttaaaaaaaaatattgctgcagctgtttgcatattctggaagtgtgtgtgcctgtgtgcggtttggtgtttacagatctggggttgcggagaggagtctccagagcaacggaagtagctgcttgtcagtcaggattcattttgaaaatgaaagcctgaaagcttggggcccattctgggcctaggcctggtctctgagaagtcagcgaaggccaggaggtggctttggccagtcaactcagtgaataaaccactgaatctcttttaaagaaaaatgaattgaccaaatctatgagttgcttttgatgtcctgcagattggagtctggagcagggatgtgggagcaggcattgaggtgctgattgtggatacatgtcccccgcccccaacatacacacacacaatcacattttcccagcctgccaaaccagaacaaggtaacaaatatttcttggataactactaggtgcacaaggatagtatgacatagctgtccaagagtttatagtttaattggcatatgagagcaaggggagagagatgtaacacaaggcagtcttggggccaaagaagtagcagaaacacagggctggggaaagagagggatcactttgggctgggataatcagaggaggcttgctagaggtggaaactaagcgcaaccttgaaagaaaagaacttcactacatagaagctcttccaggcagaggagtgtaagttatagatacgctcacgttacaagtctatccttttggctggaatttggggcttgtatgtgatttgcagttgataagccaggcttgaatgccagttcctgtgtaccagaacaaaggctatggtgtcgcacagacctgctctgccacttcctgctgggtgaccttgagcaagtagcctaacctctctgcaaactggggacagtaatgattcccagcacttgaggtcactgggaggattaaaagagttaacatatataacgcaacaagcacagtgcctggcacatagtaaatgttcaaaaccaaattacaaatgcataaactgttctgaaggaaagctctagatatttaggacttgttccaaatacgtgagggccaaggaagaaaagcttccgataccttctatcactgctgccacaggtggccccgagggagtgggctgatttggcctgagcctccatcccccttggcctagactgctggaacagtcttccgacttcctgcctctgcacctcccaaatcacctttttaacacaacctccatcatggctgtgtctctccccggctcaacaatcttctatggctccccgttgctcactgactgagctccttaagatgctgggggtgtggaggcaagaaccactatttactaagggaagggaagagcaaagagtacgctggtattaggagtgaaaaagaaaaaatatccttttttaaaaagcccctaagctttgaatttgtagaaagcggggccctggggagagagcagggatgcatctctaaagagaacagggcgctcctgcggcgccggctcagattcacctgtagctgcttctccaagccaacctgggaaaattgacgggagggaagagggtggagagcaggacagagagggcggtgcagaaggggaatatccctcctgagttccctggaagagcgtcagcctggaccctggtcttgggcttctctgctggaatcctgggcagccccgggtgctgcggcgagggtcaaggccacacaaagggcaaggcaggcagacgagccagtcacatggggcagtcgagctgcctgcgtgaatgctaggcgcgggacaatggcaactccgggacaaagtgcagggagactcctgaagagataagagggaagggcgaaggaagggggcggggagccagagcctcggagctccaggaccgcgctttgggagaccgtggctggaagccgagctcggcccgctgcggaaggggcgccctcgcgcctctacactctagccccggctgggatgctgagaaccgcggcttccagggccgcaggcgagctcccagccagtccccgcgcccgcccttcggtgctggaggcggggctgccgagctcacctggccgtttggggtgggaccgcccgcgacccgggggagctgcagaggcggcggtacccagggaagtggagctgggcttgccctggggacttggctggagctcacacccctccacgccccccaaggcctgcgcgggggccctcccctagctccctccctcctcctcctcctcctcctcctcctctcctttgctccctccctccgaacccaattgctcaagcagcttccttccccaacgccagcgccagttcctctcccgttggggcccgggaagggcagctaacgctggacactgggacggccgcggcggcagcttcaagaccatggcccagctcggaggggccgcgaaccgggcacccacggcctctctcgcgccgacctcgcagagcctgcggtgcgccccgcagccccgcccctcgagagcggacactggtagcctgggcaggtactggggcaaagccgcagccgccgcctcccgggagcaccccttcccaggcacgctgatgcactctgcagcgggctcagggcgccggcggggagcgctgcgggaactgctggggctgcagcgggcggctcctgcggggtggctgtcggaggagcgcgccgaggagctgggcgggccgagtgggccgggcagcagcaggctgtgcctggaaccgcgggagcacgcgtggattctggcagccgccgagggccgctatgaggtgctgcgggagctgctggaggctgagccggagctgctgctgcggggcgacccgatcaccggctactcggttctgcactggctggccaagcacgggcgccacgaggagctcattctggtacacgatttcgccctacgccgggggctgaggctcgacgtgagcgccccaggcagcggcggcctcacgcccctccacctggcggcccttcagggccacgacatggtcatcaaggtgctggtgggcgccctgggtgctgacgctacgcgccgcgaccacagcggccaccgggcctgccactacctgcggcccgacgcgccttggaggttgcgggagctgtcgggagccgaggaatgggagatggagagcggcagcgggtgcaccaacctgaacaacaacagcagtggcaccactgcgtggagggccgcgagcgcagtgggcgcgacggctgtggagacaagcaggagagtggcagcgtcgcggaccaaggcgaaggacaccgcgggcagccgggtggcgcaaatgcatagccttttccgccatctgttcccctcattccaggaccgttgacagggacagagactggagagctaggaggggctgtgacactgtggcgatggctaggtcctgggttgtcccgggttccaccgaaggagaggcgccttggacgctgcttgggcctgcaaggaacagaacacgtcggggtccgactcaggtacttgtctcaggtctcctgtaaccaccggcctggaggacccggggactcgggcaccacctcaccaagagagagtgaaggaccaagctggcctggctccgagttccaaagctacaggactaaggagttgggagcagggagcgtggtcctgcttgggagagggcaagttaagcttccaggggccatttctgggcaggccgacgcgctgggtttattaggaaacattcgctagaagaatgagttaagattgtaaaccaccaatgcagagaaaacgcctaactctgccggcctcgctcggccattaatgggtcttggggtgcgggtagagtcagcctctgacaacctcctcctgagacgacccagccttactggtactttttctcatgtatcacaggttacttcttatgtatattaaagtggaatatgtgttcttttcacatgacaaggctgtcctttcagtgttttcccccacctcccttactaaccacaaaggaagaaactgcatatgtttgcagggtagaggtcacccaaccatggccgtgatgttgtgccccccggggcaggctctgggcctccttctcagaacaaatggccagagctgtgcacagaagaagctacttccacttggatctgaggagaaacatacagttcacctctgtcctgagctctttgatggtctggcctcaggcaccagcctcatcctagaagagttgtcatataggggccttgggttgggggtaaaaggcaaaagtttccaaatttacatttctgatatttccacggtcagtcatgtaatttaccttgatttgtggcctctaatgagacacacccacgggcacttttttttttccaagatggggctttcctcagtagcatttatttatttatttttgaaatggagtctcactctgtcacccagactggagtgcagtggcgcaatcttgactcatcgcaacctctgcctcccgggttcaagcaattctcctgcctcagcctcccaaatagctacaggcacccgccaccacgcccggctgattttttttttttttttttttttttggtatttttagtagagacggggtttcactatgttggctgggctggtctcgaactcctgacctagtgatccgcctgcctcagcctcccaaagtgctgggattacaggcatgagccaccacgcccagccagcagcatttatttattattactgttttttgagacagagtctcactctgtcgcccaggctggagtgcaatggcgtgatctaggctcactgcaacctctgcctcctgggttcaagcgattctcctacctcagcctcccaagtagctgggattacagacgtgcaccaccacgcctggctaatttttgtatttgtagtaatgatggggtttcgccatgttggtcaggctggtctcgaactcctaacctcaagtgttcccctgcctcagcctcccaaagtgctgggattacagacacgagccaccacacctgctcagcagcatttaaaaaattaagtttaaggctgggtgtggtggctcacagctgtaatcccagcactttgggaggttgaggcaggaggatcccttgggcccaggagttctagaccagcctgggcaatatagggagaccctgtctctacaaaaatatacaaaaattagccagttgtagtggtgcaggcctgtagtcccagctactagagaagctgaggtgggaggattgcttgagcctgggaggtggaggctgcagtgagtaaagcattccactgcactccagcctgggtgacagagtgggaccctatctcaataaatatatatatttcacttacgtaaaattctttttaaaaagttaagtttaatgcataaattgtagcttgcaaaattgctcccattcagaaatggcatgaattaaatagactacaggagggttgactgagcctgaaaggccaggaaagcagttgctggctacagacccatgctgccttggagaacagtgcattttaaaaatagcactgtatccctgaaggcttgggtagcccttgcaatggactgtcgcgttccccagccctctcatcccagtccgtgaacaccagccagaaacagtcaccactaacaaacagcccagaaacgccaccctgagcccatccatccaggtttccatctctgcctggtgggcctgtttgcttctgtgctcaaaactttcctactttcctttattttttatttttgagatggcgtctcactcttacccagtctggagtaccgtggcaacgatcatagctcattgcagcctcaaacacctgggctctggtgaacctcctgcctcagcctcccaagtagctgggactacaggcacatgttgccatgctcagctattttttttgtgtgtgtgtctgtacagacagggtctcgctatgttgcttaagctggtctcgaactcctgggttcaagtcatcctcccacctcagcctcccaaagtgctggaattacagatataagactctgtgcctggcccacactgccttcctttagtaacccatgagggtcttctcaatcatgaaatgatccaaacccccttgctgttttcagcctgtcccatgtctccaggagctacaccttaaacacacttacacagtgtaatagagcatttcctttgtcttttctttctttctttctttctttctttttttttagatggagtcttgctctgttgcccaggctggagtgcaatggtgtgatctcagctcactgcaacctccgcttccagggttcaagtgattctccctgcctcagcctcctgagtagctgggattacaggcacccaccaccacgcccagctaatttttgtatttttggtagagatggggtttcaccatgttggccaggctggtctcgaactcctgacctcaggtgatccgcccaccttggcctcctaaagtgctgggattacaggcatgagccaccgtgcctggccttcctttgtcttttctaaatgaacttcttttctttagtaattgaaggagggagggctaacagttcctagattctggcagttggcattggcatctggcattaactctctccaccccgtgcccattttatagatgcgaacaggccaactgatgcaggactgtggtttctgttccacaacctcccccttgatagctgccaaggtgggttgggcttggtgaaggctgtcagggcagggccttcttgccacttggctgagtctgcaggctcctggcttgcagggaagattggtgtgtgctgagcattcaaaggacacttataacagtagtcccctctttataggaaaagtttgaacctaagcatcttaactgttagcagatctgggggcctgagacaagcgttcaccctactctttccaaaacgaaaaccaaattacctggaagatttgaaaacggttttctgtagttttcctgtagtcagctactcttccccacagatttttctcatcatgtgatactgcctagcctatctcctccatgtaaaattgaggtttggctgcaggggacaaactcccatgctgaaaactctccgtgcctcacatcaagccgttggcatttctggtatgctttttgaggcaagactggtatgcttaccccaagagaaagagcaaattccccgagaaacctctttccaggggagcaaagtggagttaagcagatgatgcaagacttcattctagcaggggagccgagcaagaagaggagacagaagcagggctgtgatggatcagggggagggggtgctgagggagcgcaggaggcagggccggatccaggtcaagaggaatagaaaaggcttttggggaggaaggtggtgcctgatctgaggctcgaggggtgagtgggagttgaccgttgagtgtggcaagtaccatgcactataaaggcagagggtttggcaggagggtggaagctggggagtggttaatggcaaggctggagaagtggaagggggtccagatcacctaaaagaggttcatgaagtttagccaaaaggtagttgggaatcatggagggtttataagcagaggagtagcatgatgagattttggaagatcactctagcagtcacctggaggatgaatgtgccaggggagaaaactggcggcaaatgcatcgcaaaagcaaaacacttctaagcaatgctttcagaaaagtcatactaacaaggctgtatgcctgtagttgctgtttgcctgtagtcccagctacttgggaggctgaggtgggagggtcacctgattccaggaagtagaggctgcagtgaacatgatcgtgccatggcactccagcctgggcaacagagcaagaccctgtttctaaaaaaattagtcattcttcaccccaggaagttcaaagacccctgtgagggcagtgcctttcaaacttctctttttttctcctccaaagtctttgctctaatgaagcttacctagaatccccatgtgtaaatctccccacccccgcctctattctagacagacagtcctacacggtggcccctggagtaaaattcaaaaccactggtgtggtggaaagctctcagccttgcctgggttcaaatcctagctcccgattcatgaccttgagctacttgctggcctgagtggcaatttcctcatctgtgaaatgggaccaatagaatattttttgcaggtttgttctgagcattcaagataatgtatgtgcaacatctggcacactgcgtgacacatagggaataggaaataacagctgtttgaaagaatcctaaggggctcagcaggttcttgtggcaaaactccattatctgctagggtagtccaggagggatcttgtggtttacctgcattatgtcagctttaaaatgaatttgcatttattgcaagttattttccatctgtgccagaggagtgactgttcctcaaaagagatgttggctcctctgctgatgttcttcacaagctatatatttttacttttgacataacaaccacttgctgaagtgcttagtatggctaaaaaggatccagatgctaatagtcaacaagatgggaaaaggccctgaaggcattttagaattcactaagggcaggctggcacagtggctcacgcctgtaatcccttcactctgggaggctgaggtgaggggttcaagaccagcctggccaacatggtgaaaccccgtcgctactaaaaatgcaaatagtagttgtgcatggtgacgggtgcctgtaatctcagctactcaggaggcttaggcaggagaatctcttgaacccaggaggcagaggttgcagtgagctgagattgcaccactgcactccagcctgggtgacagagcaagactctgtctcaaaaggtggatcacctgaggtcaggagtttgagaccagcctggccaacatggtgaaaccccgtctctagtaaaaatatgaaaaaaatcaggcgtggtggtgtgtgcctgtagtctcagctacttgggaggctctgaggcacgagaatcggttaaacctgggaggcagaggttgcagtgagctgagatagtatcactgcactccagcctgggtgacagagcaagactccatatcaaaaaagaaaaaaaaaaaaatcactaaggccacaggcctaggaggacagaatgggtttttttggggggtggaagggaaggaaagagggtgccacgcctggggtaccactgacctgcatccctactgctctagctccagcccagtctcaaagggcctcaggtactgctctggctgctgctcccaaagccataagccttggggcttccacatggtgctaagtctgcagacttgcaaaattgaagagtgactgaaggcttggcaacttccacctagatttcagaggaagtatgggaaagcctagatgcccaggcagaagtctgctgcaggggtggtgccctgcaagaattcctaccaggggccagttgagctgtggaagcagggccaccaccctcgagaccacagaatagtgcagccaccagcagcactcatcctcagcctcaaaaagcctgtggcaatggactctaatccatgagagcagccacatgggctgctcccagcatagccatggggatggggctgctcgaggccttggcggctcaccccttgcaccagtgtgcccaggatgatgggacatggagtcaagggagatcattttggaactttaagatttaatggctggccaaggcaggacggttgctggagcccaggagtttgagagcagcctgggcaacatagtgagacctcgtctctacacaaaattagaaaattagcctggcatggtggtgcaagcctgtagtttcatctactcaggaggtgaggcgggaggattgcttgagcccaggaggtcgagactgcagtgagccatgatcgcaccactgcactccagcctgggtgacagagcgacagagcaagaccctgtctcaaaaaaaaaaaaaaaaacaaaaaacgatttaatgtctgccctactgtgttttgaacttgtgtggggcctgttaccccttgcttttggggatatttctcttttggaatgggagtgtttacccaatgtctgttctaccactgtgtctcagaagtaaataccttgattttgatttttttttttttttgagatggagtctcgctctgtggcccaggtggagtgcagtggcgcgatctcggctcactgcaagctccgcctcccgggttcacgccattctcctgcct[134 bp omitted]ggcctcccacagtgctgggattacaggcgtgagccaccgcgcccggcttgattttttttttattttttgagatggagtctcactctgtcgcccaggctggagtgcagtagcgcgatctcagcttactgcaacctccatctcccgggttcaagcgattctcccggctctgcgtcctcagtggctgggataacaggcacgtgccgtcacgcccagctcatttttgtatttttagtagagacagaatttcaccatgttggccaggctggtctcaaactcccgacctcaggtgatccacccgccttggactcccaaagtgctgagattacaggcatgagccaccgtgcccagcctgattttgattttacaggctcacagcaggaaggaacttgtcctgagtctcagatgagactttggacttttggagttaatgctggacaagttaagacttggggactatttggggggatgattgtattttgcaagagagaaggacataagatttggggggccaggagcagaatgatatggtttga[184 bp omitted]cgcggcagcacgcacctgtagtcccagctactcgggaggctgaggcaggagaatggcgtgaacccgggaggcagaggttgcagtgagccgagaccgtgccactgcactccagcctgggtgactcagcgagactccgtctcaaaaaaaaaaaaaagaaatttgacacacaatgttggaggtggggcctaaaagaaggtgtttgggtcatgggggtggacccctcaccaagggtttggtgccatttttacagtaaagggtgagttctcactctattagtccctgtgataactgatttttttttttgagacggagtctcactctgtcatccaggctggagggcagtggcacaatctcggctcactgcaacctccgcctcccggattcaagcgattctcctgcctcagccccctgagtagctgggattacaggcgtggtgacgcgcgcctggctaatttttgtattttcagtagagacagggtttcaccatgttggccaggctggtctcgaactcctgacctcaggtgatccacccacctcagcctccctacgtgctgggattacaagcgtgagccactgtggccggctgagaactgattgttgaaaaaaacctgacacttccctcctttctgtcttccttcctctatcaccatgtgatgcctgctcccctttgccttccactatgactggtgcagcctgaggccttcaccagaagcagatgctggtgccatgcttcttgtgcagcctgcagaaccgtgagctaaataagcctctttcctttgtaagttatccagcctcacgtatttctttccttccccaccaagtatttccttctttctttttttttttaatgtggcccaagatgagatatttctttttaaaaaaaatttttttttatacaaacaatgtctccctatattgcccagcctggtcacgaactcctgggctcaagcaatcctcttcccttggcctcccaaagtgttgggattgcaagcatgagccactgtgcctggccccccaagtatttatttatttatttatttttgagacagagtcttgctctgttgcccgggctggagtgcagtggcgtgatctcagctcactgcaacctctgcctcccgggttcaagggattctcctgcctcagcctcccgaatagctgggatttcaggcttgcatcaccatgcccggctaatttttgtattttcagtagagacggggtttccccatgttggccaagctggtctccaattcctgacctcaagtgatccacccgcctcggcctcccagagtgctgggattacaggcatgagtcaccgcgcctggcctacaagtatttctttatagcaacacaaaaatggactaagacagacataattgcaaccagcgaacttaccttgttcttcactcacggaagtaaaagagcaacttggtaagtgcccaccaaatattaaatatgttagatattgttttcagataaagtcataaactggagtcagagttaaacctgaaatcctctgaagagaatcaaattatacaagtccttcatctcctggccctattcatctgtgggaatgccccctaaccccagctaacataacatatattccacaccaagactccccatcttccctccttcccttcattctgacaaaggagcatgcctgtcctctttcaagatatcgctcatgctctcaaccgcctctcctctcagggtttactgacatcaattgtcttctcctgcatcttcaaacttacccacagtttagttcagtacaacagacattttatttttaacttttttcttttttgagacggagtctcactctgttgccaggctggagtgtagtggcgtgatcttggcttggctcccagcaacctccacctcctgggttcaagcgattctcctgcctcagcctccccagtagctggtgacaggtgaagacagcaggacttcctgggtcgagtggggacttggagaacttttctgtggagctaaaggtttgtaaacgcaccaatcagcactctgtaaaaacgcatcaatcagtgctctgtgtctagctaaaggtttgtaaatgcaccaatcagcactctgtaaaaatgcaccaatcagcgctctgtgtctagctaaaggtttgtaaatgcaccaatcagcactctgtaaaaacgcaccaatcagtgctctgtgtctagctaaaggtttgtaaatgcaccaatcagcactttgtaaaaatgcaccaatcaacagtgtgtaaaatggaccaatcagcgctctgtaaaatggaccaatcagcaggatgtgggtggggcccaataagggaataaaaactggccacccaaaccaccagcagcaacctggttgggtctttttccatgctgtgggagctttgttctttggtcttcacaataaatcttgctgttgctctacctttataaactgtaacactcaccgtgagcgtatgcagcttcattcctgaagtcagtgagaccacgaacccactggaaggaagaaactctggacatatctgaacatctgaaggaacaaactccgagacacatcatcttcaagagctgtaacacaccgcaagggtctgcagcttcattcttgaagtcagcgagaccaataacccactggaaggaatacattctggacacatgggactacaggcgtgctgcatcatgcctagctaatttttgtatttttagtagagatgggtttcaccatgttggccaagatgttctcgatctcttgacctcatgatccacccgcctccacctctgaaagtgctggattacaggcgtgagccaccccgcctggcctattttaagttcaggtgtacatgtgtgggtttgttatataggtaaacatgtgtcatgggggtttgttgtacagattatttcatcacccaggtactaagcctagtacccattatttagagatggagtcttgctctgtcacccaggcaggagtgcagtggcactatttcagctcacctgcaacctccacctcccaggttcaagtgattctcctgcctcggcctcccgagtagctgaaactatgccctgcctggctaatgtttgtattttcagtggagacggggtttcaccatgttggtcaggctggtctcaaactgacatctggtgatctccctgtctcagcctcccaaagtgctgggattacaggcatgaaccactgcactctcccattatttttcttgatcctcaccctcctcccaccctccactctctgataggccccagtgtgtgttgttcccctctatgtgtccatgtacaacagacatttagtaagtcattaataggagtgtcactctgagtgacaaaaaagctcaagtcttccctagccttctggctcaaacttgtctcttctcttcatagtaaagcctgtctgctgagaggtctcctcacttcatcatctccatttccttacctcttcctcagtccttaactttctgcattctggcttctgcctctatcatcccagagtaattgcttccagaaagggcgtggtggctcacacctgtaattctaggactttgggaggtcaaggcagggggatcacctgaggtcaggagtttgagaccagcctggccagcatggcgaaaccccgtccctactaataaccaggtgtggtggtacatacctgtgatcccagctactcaggaggctgaggcatgagaattgcttgaacccgggaggtgtaggttgcagtgagccaaaagaaaaaaaaaagtcccccatgatgacctcctgtcttagtccattcttgttgctataacaaaataccttagactggaggctgaggcaggagaatggtgtgaactcaggaggcggagcttgcagtgaactgagatcgtgccactgcactccaccctgggtgacagagtgagactccgtctcaaaaaaaaaaaaaaaattatcttagactgggtaatttataaagagcagaaatttgttgctcactgttctgtaggcagggaagtcccagatcaaggcaggtttggtgtctggtgagaggtggttcctcatttatggcacctttgtgtcctcacatggtggaagagatggaagggccaggcagctctctgaagccttatttatttatttatttatttttgagacgaagtctgtcactgttgcccaggctggagtgcagtggcgtgacgatcttggctcactgcaacctctgcctcctgggttcaagcaattctcctgcctcagcctcccgagtagctagcattacaggcacccgccaccatgcccagctaattttttgtatttttagtagagatgtt[143 bp omitted]gcctcatgacttaatcacttccccaaagatccctcctcttaatattgtcaccttggggattaagttccaacatacacattttttttttttttgagatagaatctcactgtgtcacccagggtggagtgcagtggcacgatctcagctcactgcaacctctgcctcccaggttcaagcaattctcctgcctcagcctcccaagtagctgggattacagacgcccgccaccacgcccggctaatttttgtatttttagtagagatggggttccaccatgttggccaggctggtctccaactcctgggctcaagtgatctgcccacctcagcctcccaaaattcttggattagaggtgtgagccaccgtgcccggcctacaacatacacatttcagagggacacatatattcatgcctttgcacctcccatctgccaaatccaagtccttatcttagttcacttcttggcagcactgaacaatgttggctacttcctcctgtttgaaactcttgtctagtcttccataacctcctatggctttaattgctggggtttaccaggatgaagttctggaagcttttctcttcactctacattctctcccaaagtcctgttttttgttgttgttgtttgttttgttttgtttttttttttttttttttgagacagatgcttactctgtcacccacgctggagtgcagtggtgtgattacagctcactgcagcctcgacctcccgggttcaagtgatcctcccacctcagcctcccgagtagctgggactataggtgcatgccaccacaccaggctagctttttgtattgtttgtagagacagggtttcaccctgttgcccaggctggtctccaactcctgggctcaagtggcccaccctcctcaacttcccaaagtgttaggattacaggcatgagccactgcaccctccctgcctctcccaaagttgttttttcccttccccacttaccctccctcactctgctccagccactcagtcctccttgctgatccttcgaacagccatgttcttctcaaccctggggttcctgcatgctgttcactctccagaaacactttcccctctcccttgctcctgacttcacctgacccactcatccttcattcacccactcatccttcatttcaggtgtcagattaaatgttacctccttggggatgtcttccctgctgctcaggctatgttaacactctacccattacactcactcatgaggccccgggcatcttttcttttttccttgagatggagtcttgctctgtcgctcaggctggagtgcaatggcgcaatctcggctcactgcaacctccgcctcccgggttcaagcagttctcctgcctc[136 bp omitted]cagcctcccaaagtactaggattctgtaatcccacagattacagaatcaaggcgggtggatcacttgagcccaggagttctcaatcagcatgggcaacatggcaaaaccccatctctacaaaatagaaaacaattagctgggcatggtggcacatgcctatagtcccagccacctgggaggctgagatgggaggatcacctgagcctgggaagtcgaggctgcagtgagccatgatcgcgccactgcactacagcctgggtgacagagtgagactctgtctcaaaaaaaaaaaaaaaagcatcaacgttagcatgtggactgctgctgagaacccactgattcgggatggagaggagtaggctaggattagagggactggtaagaggctatggtctgtagagtcagatggacagataagagagatttcatggaatcaacaagacttgtgattgactgaatgtaggggaggaggaagacagaggtggcaagggtgatgctcaggtttctgacttgagcaacagggtggatggtggtgtcatttactgagaggaagggccatgagaagaataggtttttttggtgggtaggggaaggggatcaaaacttgttttggatacattaagtttgagattggctatatgacatcgaggtgaagagatccaatagacagttggatacgtggataagcaaatcaagagagaactggaggtagctgtggggttactggagggtttttttcttttctttttttttttttgagacagagtctcgcactgtcacccaggctggagtgcagtggcgtgatctcggctcactgcaacctccccctcccgggttcaagcgattctcctgcctc[134 bp omitted]gcctcccaaagtgctgggattataggcatgagtcaccgtgcccggccaggagaggggttttattttggcttgggaggcacagcttgtttgtgtaatgacacaaaggactcaaaagaaaaggagaagtaggaagacagaggagtcaacacgaatagtcaatggatcaaagctcccaagaggtgggaagggataaggcagagcataggactaggaatttgtctcacagaggaggagactctggagtcagacagtctgattagagcttagttctaccaccttctagctgtgagaccctgggtaagtcactcactctccctgagtcttactttccttgactataatacaatggaattggccaggactggtggctcatgcctgtaatcccagcactttgggaagc[134 bp omitted]gaggcagagaattgcttgaacccaggaggcagaggttacagtgagccgagatcgcaccactgcactccagcctgggtgacagagtgagactccgtctcaagggggaaaaaaaaggaattatgagtacctgcctcataaatttgggctgatcattaaaggagataatgcatgtaatatgcttaccattgtgtcttgcacataggaacattgcataaatggtagctgttattattataacaggagtgcaggaggaaaaagagggcgcacatacaggtgagttcacaggtttggttgcaggaagttaaacacattctgttttttcttttctttttctttctttcctttccttttttttttctttttttttttttgagacagagtattgctctgtcacccaggctgcagtgcagtggcaggatcttagctcactgcaacctccgcttcctaggttcaagtgattctcttgcctcagcctcctgaatagctgggattacgggcatgtgccaccaagcccagctaatttttgtgtttttagtagagacggggtttcaccatattggccaggctggtcttgaactcctgacctcaggtgatctgcctgcctcagcctcccaaagtgctgggattactggcatgatccaccacgcccagcctactaacctcgatgatttcttaaacccaaacctgataggccactgtctacttttgaactctttaatgtttctcttggcctcaggatagaattgaagctctcacttaagacttagaggctcctcgtgatctggcgtctgcttacctctccagcctcattcctattcactacttcctgttcgcatcctctttcttcacccacgaatacatcccctttctacactcctgccatgcagtaactttcagttcccgatctcccagctttctcttgactgggccttttcacagtctgtttcctctgcataggacatgaacgttccacccggcagcctcagccgcaaaacctagctcctcgtgggcctccagggctcagtttgctcttcctcagtccctcccgtgttcggtacaggttcccaagaccctagtgccttccttgccgcagcactctgcactaggagctgtgtcggcactgtcatctgcctccatgtaggctgggagtccaagaagatgtgggcctgtggttgtggttcactgctgcagctcagcacccagcacagatacaacactatgtatctgcctcatagtctgaaacgggtgtttgagaatgaacaagtgggagttggaggcagctgaccttgaatttagatccacaggctttctgatttaactaatagttgtgttttttgtattcatttgccttcagttcccatgcccttcttcctttggagagccccgtggaaacaatttttcttttttctttcattttttgaaacagagtttcactttgtcaccaggctggagtgcggtggcgcgatctcagcttactgcaacctctatttcctgggttgaagcgattctcctgcctcagcctcccaagtagctgggattacaggtgcctgccaccatgcctggctaagttttataattttagcagagatggggtttcaccatgttgaccaggctggtctccaactcctgacctcaagcgatccacccgcctcagtctcccaaagtgctgggattacaggcctgagccaccatgcccggcctggaaacagtttttctaatgaacaccatgttagatgtacattagacagttacaaatgtggcattataggttcatgattttagaggttagcgatcaagtccaatttcctcatttcaaatggaagaaaacaggtccccaaagctgtggtggcttgttagtggcaggctagttgtagctgtaaaactgggactaagcctcagatttcttgataccagtgctctttctcctttcccataccatgctgtgatggattaaagatgaccataagtcctttgatactcttcccattgagaggtggcctctatcacactttcccttgaatctggatgggttctggaactgcttagaccaaaaaaatacaggaaaagggataacccagtctgggtgggaccagctacgtaatttgtggagcccaaactgaaaatgtgagaccccttttaagaaattaagaatttcaagaaagactgggcgtggtggctcacgcttgtaatcccagcactttgggaggccgaggccggtggatcacttgaggtcaggagtttgagaccagtctggccaacatgttgaaaccctgtc[132 bp omitted]gctctccagcctgggcaacacaacaaggctccatctcagaaaaaaaaaaaaaagggatttcaagatagcaaaatcagagcatcaagctaagcacagagccctgtgcaactgcacgaccacccccaggaagctggtcccggtgccagttttagggcccaggtcttaagagactggcagcttccagttcctgtctcttggaacacatgatcaggccagtcatcacataagcagtcatctacccaagaccatcatgccgtgagaaggccaagccacataaagcggccctgtaggatgagatgccatgtaaggagagggagaggaaggccaagcagcactaaggcacccagcaggtgagtggaaaaggcatcttggaagcgaatcctccagccccagctacccccactagatcagaaaaaaagcaatcagccaaggtcttcccaacttcctgacccaggaatggaaacaaaatgctcgtttcaggccactaggttttgggatagtttgttacacagcaatagataacaggaacacatactatctctagcattcttcaaaatgccagtgaaatgctgtcttttgaagcacaaagttctgtttgtataaagtgtcatcattctgtgattcccaaattacatactaaatatatgtgtatgcatattgcaagcatatgaatgtcactttggtgataaaaatatataaatgtggccgggcgcagtggctcatgcctgtaatcccagcattttgggaggccgaggcgggtggatcacttgaggttaggagttcgagaccagcctggacaacatggtaaaaccccgtctctactaaaaatacaaaaattagcagggtgtggtggcacacacctgtagtcctagctacttgggaggctgaggcacaagaatcgcttgaacccaggaggcggaggttgcagtgagctgagatctcaccattgcactccagcctgggcaatagagcgagactccatctcaaaaataaataaataaattaataaaataaaatataaatatgcacttcacactacggacatacattgttttggcatcagccatatcagaccttttttatttaaaatatgtaagttcagaatattttccttggcctctgtgaatacttctctatcattgtgcttataacaatgtgtgataattgtctatgtatttatctccttgactagatccatgcctttcaaactacacaagcaacctattagtggggcatgaaatccattttttcaatgaaatgggataaaataaaaacataagtatgcattgcacacaagtaagtatgaaatcaagaaacttgcaggattgcaggattgtgtgtgtgtgtgtgtgtgtgtgtgtgtgtgtgttgtggccactggaatagattgtgagatcctaagggcagggttcatgcccaacctattcaccactgcatccccagcagccagtgcactgtttggcacatgtaggtgttctgtaaatatgtgttaaatgaatgaaatttattcttgaatgctcctattaagagatgaacatcctcatcttcttgggacccttcaccctttcctaagaatagtactgggctcgagacttgtacttcagggagtcttacagcaatgtatttattattcatccattttcagttttcagtttgggtctacatatctacaccagtgtgaaatttctgttaactgcctgccggaacagaaactatctactccctccccaaatatgtcaagagtaaaaaaggagggagagagagaggaagagaaggaaggaaggaagggagggagggaaggaaggaaggaaggaaggaaggaaggaaggaaggaaggaaggaaggaagaaaggaaggaaggaaggaaggaaaggaggcagggagggaagaaacaaatatcagttataggtttatatcagaaactcttttttttctattttatatatatatattttaaatacggatggggggggcggtctcgctgtgttgcccaggctggtctcgaactcctgggctcaagtgattctcctatcttggcctcccgaggtgctggaattacaggcatcagccactgtgctgggcctataccagacattcttaaagattgctattatacaataggccaggcaattttaacacaccatctcatttaattgccaaagcaagttatagcacaatatttaccccattttacacattttacacatgctcagggaggttaagtaactcctctaaagtcacctaggctgggcacagtggctcacacctgtaatcccaacactttgggaggccgaggcaggcggatcaccagaggtcgggagtttgagaccagcctgaccaacatggagaaaccccgtctctactaaaaatacaaaattagccaggtatggtggcgcatgcctgtaatcccagctactcatgagggtgaggcaggagaatcgcttgaacccgggaggcggaggttgtggggtgagctgagatcgtgccattgcactccagcctggccaataagagtgaaactccgtctcaaaataaataaataaataaatgaaaataaagtcgcacaactactaagtgagaggtatgtatttgatgtgaactcaggcccggccagctccatagctttgtgagcgctccatgtcgctctgctgcccccatgcagttaaccaaagcacctacacgaagtgttttgctaagacaagacatcctatgaataggacattttctctatcaatctatgcggaactgacctatgtagacacaacttaaggtgtttatgatgcagacatcatcagtggagttcatcaacttttggtgatttgtaaataaaccaggaactcactctaccatcagcatgccttcttgagtgccacactttaaaatgcatatttcattaatttcacttcaggtgtaggtgtttgctcggttattttcataaatgaatactcatttcatttattttgagacagggtctcactctgtcacccaggctggagtgcagtggcacaaacctagctcattgcagcttcaaactcctgggctcaggcgatcctcccacctcagcctcccaagtagaaggactacaggtgtgtgacaccacacctggctcattaaaaggatttttttttgtagagatggggtctcactatgtttcccaggctggtctcaagctcctggtgggctcaagtgatcctcctgcctcagtcttccaaagtgctggaattacatgtgtaagtccctctacctggccttattttattttaaaataaagtcataaagttatattttagaatagttttagatttacggaaaagttgcaagaatattagagagttcctgtatagcctgcacccagttttcctatggttactttatttttaaatatttaatttaatttaattaatttattttgagacggagtcttgctctgttggcaggctggagtgcagtggcacggaccttggctcactgcaacctttgcctcccggattcaagcaattctcctgcctcagcctcccgagtagctgggactacaggtgtgtgccaccatgcccggctaatttttgtatttttagtagagacagggttttgccatgttggccagaatagtcttgatctcctgacctcgtgatctgcctgccttggcctcccaaagtgttgggattacagacatgagccactgcgcccagccaacaaatgcatttattgtacctccttcatgccagatgcagtttgttgaaagcaaagtgtagcgagcaagacatacccttctggatctatccttgtggagctcacagtctagcaaaggaggcagacatcaattaattgaccacacatgtaaccttatagttacaattgtgaaggaaaactacagggtaatttaagaggtagtaagcagaagaacctaactggactggaagaagagagggggaagtcagggaaggtctccctgtggaagtgacaagcaggttgagacctgaagaatgaatggatgttaaccaaatgaagagggagaacattccaggacaagggaatgggaggtggtactttctgttttgttttgtttttgagacagggtctcactctgtcatccaggctggagtgcagtggtgcaagctgggctcactgcaacctctacctcgcgggttcaagcgatcctccccacctcagccccccaagtagctgggaccacaggtgtgcaccatcacgcccagctaagtttatgtatttgaggtagagacggggtttcaccatgttgcccaggctggtctcgaacttttgagctcaagcaatccacccgcctcggccacccaaagtgctgggattacaggcatgagccactgcgtccagcttacctttttcttacctgtaaaatggaagaatatctagtggaattgatccttttctctttttaaaaactttttacggccaggcatggtggctcacgcctgtaattccagcactttgggaggccgaggctggtggatcacctgaggtcaggagttcgagaccagcctggccaacatggtgaaaccctgtctctactaaaaatacaattagctgggcatggtagtgcaggtctgtaatcccagctacttgggaggctgaggcaggagaatcgcttgaatctgcgaggtggaggttgcagtaagccgagattgcgccattgaactccaagagcaaaactctgtctcaaaaaaaaatccaaaaaacaaaaaacaaaaaaaaacaaacaaggctctgcacagtggctcacgcctgtaatcacagcactttgggaggctgagacaggcagatcgcgaggtcaggagtccaagaccatcctggccaacatggtgaaaccccgtctctactaaaatacaaaaaaattagccaggcgtggtggtgcgtgcctgtagtctcagctactcgggaggctgaggcagaggaatcactcgaactcgggaggcggagattgcagtgagccgacattgcgccactgcactccagcctggcgacagagcgagactccttcccaaaaaaaaaacaaacctttttacctgggagcatagactgaagttaccttgaaaatacactcctggaactaatcctttacagacatcattcaatccttacaaacctgaggtagtcaggtatgactggatataaaagtcttctaagagagcaaggtcccacagttggttcagtgatgaagctgggattcaaccttaggcttgcctgcaagaccttgaggggttactctgtccctccaaattaaaaccctggagttggaagagaactggcatcaatttagcagcttatgttgagcaccaactccatggcagctcagcctgattttatctcagcctcccatcacaacgtccctctccctgtgccaacatatggtgcatctgtgctggggactgacaccaaaacgttcttcctgctcactccctactcctcatctccttttcctagtcaggcaactgaaccaagtgctttggtgcattattaaatttcatcctcacaaccttctgagggagaccccattttgcagatgaggacgctgagggcttacaactggtgagtggtggagagcagggttttgttttgtttagttttgagatggggtcttactctgtggcccaggctggagcgcaatggcacgatctcggctcactgcagcctccatctctcaggatcatgcgattctcctgcctcagtgtcccgagtagctgggaccacaggcatgtgccaccacgcccggctaatttttgtatttttagtagagacagggtttcaccatgttggtcaggttggtctcgaactcctgacctcaaatgatccacctgcctcggcctcccaaactgctgggattacaggcatgagccaccatgcccggcccgggagcagtgtttaatgaatccagactatagtctggtgatacacagacagcagcaaactcaaccaatctgctgcctgcctctcagtaggtcaagggatgggcagtgtcatcacaagggtgacttcctgtctttcaaaacctgtcatctaatgcttcccttctttactatttcagtaccattttgaaatcttaaaatacatcgcaagttccccttccttccttcaagatgcactgatctaacccaactcccttcatagatatggggaaacaggtactggcaattgtacaagatagcgaggggccactggatccagaccccacagctttcaactcccaggctccaaataaacccctcacacacggctaaccccatgtccatgtcattttccctttctccaaatcctaatcctaccttccgagtagttgggattacaggtgcaatacttgggtgcctgtaatcccaactattcgaggtctgtagagaaagctgcctatgccattagatcttggccttgtcacttaacctccttgggctctgttagcaaacacccaacctactctgaagcagaagactgctttctaatgctctgaaatggttagaaatgtccctgtcttgtgactgccagttaattttatcaagtccctctcctttggacttgagtatcgttttttgagacagggtctcactcttgtcacccaggctggagtgcagtggcatgatcacagctcactgtagcctcgatcttccaggctcaggtgatcctcccacttcagcctcccagatagctaggactacaggtgcactccaccctggccaatttcttgttttgccatattgtgcaggctggtttcaaacacctgggctcaagcgatccacctgcctaggcccctcaaagtgctgggattacaggcgagccactgcgctcagccttgagtaacatttttaagtatgttaatatttaccaactgctgttcacagtggcaactttctttgaatatgaaggcatcactgatgcaataagaaaaaatatttgcagtcaggccggggacagtggctcacacttgtaatcccagcactttgggaggccaaggcaggcggattacctgaggtcaggagttcgagaccagcctgaccagcatggcgaaaccccatctctactaaaaaaaaatacaaaaatgagccgggcatggtggtaggcacctgtaatcccaactactgggaggctgaagcaggaggattgcttgaacccgggaggcagaggttgcagtgagcccagatcacgccactgcactccagcctgggtgacagagcaagactccgtctcaaaaaaaaaaaaaaaaagaaagaaagaaaagaaaaagaaaaaagaaaaaaaattgcagtctaggggttcaggagataggttccaaagatccctttaaagctcctaatttccttggtattctggagctcactcttcacatttctggtgagcgccatgctcttaggaattgctttttttttttttttgagacaagtcttgccgttgcccaggctagagtgcagtggggtgatctcagctcactgcaacctctgcctcccgggtctgagcaattctcctgcctcagcctcctgagtagctgggactgcaggtgcgcgccaccacgcccggctaatttttgtacttttagtagagacgaggcttcaccacgtgggcgaggctggtcttgaactcctgacctcaggtgatccatctgcctcggcctcccaaagtgctgggatcacaggtgtgagccactgtgcccagccggaattgctttcatctgaacctcctagtgtggttgtaaggcagggacccctttgctgtgcaatcccaccattaccacttgcacactttatgcagcagcccacatcttctgccacctgccttctcagctatgtccaggcagcacaggccccctatcgactgggcagggagttacagccaaaccctgttctttcccttgttgctgcagtttcaatcctaattccactggtatttgggggagctttgttccctctcacgttttctacagaaaagatctgctaaggtttgtatattggcctattcgttgttaccacttaacatgccacataatttgtctatcaaccaatgaattccaagtacctagaacagtgtctgacacaaaggtggccaataatttgttaatgcatctctctaaatatgaagttgctactggttctttgagatgttaaacataattccctgatgattcgtcagccagggaaactgcaaggggtaccgaagaagctgcactaacccagtaaaagctcaaatccacaagatttccaccatgtacattcactcagctgtagctcttcagtaagtcaggcaatagcattacctgttacaatgtcaacaattaacctagattttttttaaacaagtgaactcgcttgaatccaggaacaggggtgggcaatctttttgcataaagagcaaagtagtaaatattttaggctttgcaggccacattatctctgtgcacaagggtgcatttatatacataatacgtaagttatgcatatggctgtgaaacaagaacattttatatggacagaaatttgtatttcaattttcagatggcataaaatattctttcaactatttaaaaatgtaggaaccatatagttcacagactgtacaaaaacaggcagcagatggctggacgcggtggctcaggcctgtaatcccagcactttgggaggcagaggtggtggaccacctgaggtcaggaggtccagaccagcctggccaacatggtgaaaccccatctctactaaaaataaaattctgcgattgctatttccctgcactagacgtgaatgggggagttgattaattgtaaaactcatgtgaggccgggcgtggtggctcatgcctgtaatcccaacactttggggaggccgaggtgggtggatctcaaggtcaggagttcgagaccagcctgaccaacattgtgaaaccccatctctactaaaaatacaaaaattagctggatgtggtggggggcgcctgtaatcccagctactcaggaggctgaggcaagagaattgcttgaacccgggaggtggaggttgcagtgagctaagatcgcaccactgcactccagcctgggcaacagagccagactctgtctcaaaataaataaatacattaaaaaaaaataaaataaaatttacagaatcagtcctttacactaaacacacttcaagcacatggtagccagagaacatttctatcattgcagaaagttctactggatagtgttgttattaggtttggcagggaagggagaattcagtaattgacaaaccacaatacaacagcaattaaaaagaaaggccttacatatttattactgaatccagccaaccaacgtgttcataacagattcagagaggaaaacacgtcgaaatctccagatagtggtgacattttcagcttgatatggtaacatgatcgtgaccttcagacagcataaatatgtgtgccatctcatgtgcaattccttatagacccagcttggttcttctccaatgtctccttttggagttgtacctacacagaaaaaaatgtcaagttacaaaggcagtctgacagcaatgtagctgttcccattcacataaccttttaggtaccacaaaatacaaagggtactgcttttctctcctctaacaagtttggagttctttctggagagtaaaaaaaataattccctatgtgtttaaaaactagccaagtcaagttttatcctctcaaaataatttgaaggctaggctcttaactaggatcagagtagtggcgaagcccactctctccaagtgtacttgtacccacttttgattcaatggacctggaggtacacagacatactctgaaccccctcataatgggtcacaaacatataaaagctcccgcatgatattttttttgagacagagtcgcccgcccccccaacaccacccagctaatttttgtatttttgtatttttagtagaggcagggtttcaccatgttggccaggctggtctcgaactggctggacttcgagatccacccgcctcgtcctcccaaagagttgagattacaggcatgagccactgcacctggcctcgcatgatctttacaatcgatcaactcctccattcacgtctagtgcagggaaacagcaatcccagaattgtccatgtcaatctgtcatgattttaccctcataaaggcaaaatcaaaaatgattaacacggcttttctttcagcaggataatggcagtacttccacaaaatgaagcactgtaattgcaacctgctttcaaaaacatttttaacgctggaagatagctaaaacaatgaaaatcattccattgggtcaattatctgggtcaagggtatataatcttacgtacaaaataccttcccaattctaggagaccacagagtttaatagcaggttatttattgaactaggcgttgagttttacatacatttttctttttttgagacagggtcacactgttgcccaggctacaatgcagcggccggatcacagctcactgcagcctgtgaattcctgggctcaagtgatcctcccacttcagcctgctaaatagttaggactacaagcacgtgccaccaagtccagctaatttatatttttggtagagatggacgggggtggtctccctatgttgcccaggctggtctcaaattcctggcctcaagcaatcctcctgcgttggcctctcccaaagtgctgggattataagtatgaagcactgtgcctggtttatatatacttctttcactcttcacaagcaggtcccaccatcaggcaggacacagagaaacccacgttcaagtagatgtatcaaataataaaggacagtgtctagtatccagtaaacaaatggtaagcaattaactagcccataacattacaatgggtggcaattttcacatctaactagctaaatgaaccaaggaaataggccctcaactttagccctaagaagccacccctttaagtcttcttagcaaaccaatcccactagctttgccatacaagtcgaatcaagttctggctgggcgcggtggctcatgcctgtaatcccagcatgttgggaggc[134 bp omitted]gagcaagagaatcgcttgaacttgggaggcagaggttgcggtaagccaagatcacaccattgcactccagcctgggcaatgagagcaaaactccatctcaaaaaaaaaaaaaagagaaagtgctttgactagcctgggcaacatggcgaaaccccatctctacaacaggtacacaaattagccaggcatggtggtgaacgcctgtagtcccagctactcaggaggaggctgaggtgggagggttacaccactgcactcagcctgggtgagagagcgactgctgaaccttgggcaactcttgctgattcttgatgctcccttcaaaacctgtctcaaggcccatcaggaccaaagagcgatgggctgaaaaagccatgcaggagactgtttcaggcctagctttccctggagttagtctagatgaccttggaggtccttcatagcaattctagtaatgtttttcctttgagatcaactacttctgcagtagaggacagttttccaatcttttctagtctctttttagaaaagagaaacatctaaaagactgggctaggtgtgatggctcacgcctgtaatctctgcactttggtagggtgagacaggaggattgcttgagctcaggagttcaagaccagcttgggcaacacagagagaccccatctctacaaaaaatttaaaaattagccaggtgtggtggcgtgtgcctgtagtcccagctactcagagagatgaggtgggagggtcacttgagtctggtaggtagggagaggttgcagggagatagtgtcaacgcagcatgtaaaacagaacaagatcctgtctcaaaaaacaaaaacaaaggccgggcacaatggcttatgcctgtaatcccagcactttgggaagccgagaggggcagatcacttgagctcaggagtttgagaccagcctggccaatatagtgaaataccatctctactaaaaatataaaacttagctgggcgtggtgacgcacgcctgtagtcccagctactctgaaggcggaggcaaaagaatcacttgaacctgggaggcagaggttgcagtgagccgagattgtgccactgcactccagcccgggtaacagagcgagactccgtctcaaaacaaaaacaaaaacaaaaacaaaaacaaaaagcctaaaaatactgactgggtcttccccaccaggatgtgtataagacagccttccaccttatgacctagctcagactgaagatgaccaggaaattaataagtattggagaattatctgcccataagcccagatgtgggctggatgcagtgcagaaacaaaggaagtacgtttttaaaaacgaatttgagaatgctgtcaaagggtggattggattgcatgcaattttaatcatgtatttatactcaaaaagtaaccctggccagacacagtggctcttacatttagcaaaatacaagcagtatgatggaggtcttacctgattttatttccagttttcatccgaatccactggggaatgggacgattttgcttttgtttcttggccaggaatcgcttaatcctgaaagtcttgtgagaagactgggaagaaaatgcaatcaatttagacaatattagagcctgcccgaatgattcaaagtcaagaactccttcaaaccaacatttgagtgcttaacacataccccagccccaaaatcttctcaatgctaagccatcaagccaagcaagtctctgaccctcacaacttctctgggggcagataccacagtttccatcgttcagataaaataagtggaatccggttaagaaacatgcacaaaatcagagcatcaatgtgcagaaccaggattcaaacccaggtcctttctgctccacagccagaggctacctttcaatttaccctgtggtcccccaaggactcagacgaccacactgggaatggctagggaatctggcttcctgggaagaacacagctttgagtcaaacagaaccacctacctaccatttgcaagtcaacgaatctcagtgctctactttgtaaaacaggggtacgtacttttcaagtgttattgggagggtaattaagacttagggaaagtccctgacattcagaagatctaacctactcaccatttcggtattaatcctaactctatctctactgctaaatttcactggctaaaaaaataaacttttaaatttaaaaataaatgaaatgtcacttttccaaggatgactgtctcaatttctagttgcatcttttggctttcatctaaggccaaccccaatactcccccaaatctacagaataatcttgcaaaattggcacggatgcaggtttaatgcctggccaacctggacgaacatacccttgcataataatgggagccaatacaaagaaggcaaagattacaccccgtcccccatccacagtagcagttgtaaattttgtcaagtaataaattacttgacaagtaataaaataccagtacttatcgcctccatatctagaaatcaacattttacatttcccagtaaagagtgactggttcgctgctgccatttactaagaaggccagaatgacacacaggttcgcaaaacaccccttgttctaggcgcttccacggggtgacgctcaagtctctgaataaacgtcctctaaacaaaagtcctgggatctaaaaatgcggttcgcttctccacgccaagctaaacccttttcgaaaaccagtagcccacaataccctcctgattaccctccacgttgcgcatgccacgggcagcccacagtcaggccacgatttcgggggtggctgccacctcccaccccccgcctccagaacgagttcgctacaagcgaagggaaaccggaatccctgcccgactcggcagcggccgggcaaagaaagagcccccttgaatccgcggccgcagcgcagcccgtccctctccaggttgctcgctggctcactagcttccctccaggccacgaaagacaacagtggccgaactggatattttcttgaaaaagcctttaaaaggctcccgcccctcaacgctccgcgcggcccaggcatttcctggcagcggcctcgggttttgggaagccaccccggggccgatgggggccgatggacttaccatggcgagcagcggagtcaagaacacaccacgatggcggagaaaggaagaggagggaagctggcggaagaacgagcttagaaggcgcttccgatgggcggagtttaggaggtgacgctatgcaccgaccgcctcttctagtgccttctctgtctagcggtgcgctcccgtggcgccgtgggaaagcgcgctggtttctgccaaatgcagttagctttgcttcgcttccctaagtgcgttcccccaggggcccggcagtgtgctaggggcaccctgcttcgtaagtgaggcagacagcccgtgataaatgccaaagtagaagcccctccgaaaaattaaggagccgattgggcgggactaaccctaagggagggcaggggaagcgaccgtcacctccgggcgccggggactcggaacgccgggtcggagctcggcaggcggagagtaagtgccattttcccagagggttacgagtcatttcggcctggctgggaggtgtgggaagggacagtcgtgtcggaggaagccggagaagttggagggggttggaccacgtggacgcttatgtaagcctaggggttttcgactaggcggaaggttgccaatcaaagttttcaactcagaaagttagggacagaacctcttccttggctgctagaagtccagcctgacattgtagcccgcctttggcaagatgtacaataattaataacatgcgtttgggatgctagtgttccccattttcatccttttccccatttaaaagcaaaaacctttcctttttgatgagtaaataaaataaacataaaaataagctgggcgtggtggctcacgcttgtaatcccagcactttgggaggcctaggcgggcggattacttgaaacgaggagttcgagaccagcctggccaacatggtgaaaccccgtccctactaaaaatacaaaaaaactaaccaggcgtggtggcgggcgcctgtaatctcagctactgcgggggctgagacaagagaatctcttgaaccctgaaggcggaggttgcagcgagccgagattgcgccactgcactccagcctgggcaacaagagcaaaactccatctcaaaaaagaaaaagtaaataaataaacgcaaaaacctccatgtatatttgcagtcacctcaagcatttttacaccaacggattacagcaagggtttttaacctggagtccacaagagtccatgtatagaattcagaggatcccatgaacttgaatgggaaaatacaactttattttcaccaaatttaatgaaatgtaatgctttctttatttaggaatgtaggcaacagaccacagtggcattagcagtactcgtgacttggtcactaatagaaaccatagatggcttcatgttacattacagttgatgcagatgtctccatatattatttacacactccctttaaattacattagttataagttcacaaatagaactatgttaagaagcccatgtattactatagcacatatttcctttttttttttttcaagactgagtctccctttattgcccaggctagagtgcaatggcacaatcttggctcactgcaacctccgcctcccgggttcaagtgattctcatgcctcagcctcccgagtagctgggactacaggcacgcactaccacacccagctaatttttgtatttttagtagagacggagt[132 bp omitted]attagagcttcaacacatgaattttgggggaacataatttagctcatgacaccaccagtcaccttctaaggccgaattcaaatgctgtctcttccccttagctggaaatcatcaccccttcaacactgttgtaatagtttatttgtacctttcttatggctcctagcactatctgttctgttgcaatgcaaaaggatgaaagtaacagtggctgctgcttatggggcttgatagttactatgtagctgcatgtattaattcaagcctcactgtgagcttaccatgttttaccagtgaccttttgaatcttcaccagaacactacaaggtaagtatggttaatcatcctcattttacagaagagggaactgcaacagggacagattaagttgtatacccaaggtcacacagctactatgttgcacagccggtactcagactcaggtagtccaggcttcagagtctgtgctgtcaccactaccctctactgccttttcaacacagattttgggaacctactctgtctggttcgggtcttcgtgttgggggtacagaagcaaacaaatctgaccaaaaatccctgccctcttggagtcttgtggcgatggtatggttctggatttttttgtggtgggaattacacaaagctacacgtgtgatagaatttgccaagtgtggtgactcacgtctgtaatcccagcactttgggaggctgaggcgggcggatcacctgaggtcaggagttcgagatcaacctgaccaacatggtgaaaccccgtccctactaaaaatacaaaaattagccaagtgtggtggcgcgcgcctgtaatcccagctactcaggaggctgaggcaggagaatggcttgaacccgggaggtggaggctgcagtgagccgagatcgcgccactgcactccagcctgggtgacagagcgagactctgtctcaaaacaaacaaaaaaaattagccgggcatgctggtgcgtgcctgtagtccaagctactcaggaggctgagacagagagaattgcttgaacccaggaggtggagggtgcagtgagccgagatcacaacactgcaccccagcctgggtgacagagtgagactctgtctcaaaaaacaaaaacaaaaaaacaaaaaaaacaattctatacaactcccccctgcccacccctgccccaaggggcatatgtataactggtgaaatctgaataagctctgtggactgtgccaacgtgaatttcctggttgtgatattgtactatagttatgcaagatgctaacactggggaaaactagataaagggtacacagggcctctcagtccctttctttgcaacttcttgcgaatctattgttatttcaaaatacaagtctaaaaaaactctgccttcattgagtttaattatagtggggagttagacaacaaatatgtaaattacatggcacatcagaaggaggtgtcatcaagaaaagcaaagcaggggccaggtgcagtggctaacacctgtaatcccagcattttggaaggctggggaaggaggaatagttgagaccaggagttttagatcagcctggacaacatagtgagactctctacaaaaaatacaaaatttagccactggatgtggtggcacgtgcccgtagctccagctacttggaaggcgagaagggaggagcgcttgagcccaggagttcgaggctgcagtgagccatgattgtgccactgcactccagcctgagcaacagagtgagaccct[150 bp omitted]caaaaaattagccgggtgtggtggtggcgcctgtaatcccagctactcgggaggctgaggcaggagaatcgcttgaacccgggaggtggaggttgcagtgagtggagatcatgccactgtacttcagcctggtgacagagggagactccgtctcaaaaaaaaaaaaaaaaaaattgagaaagggtggcatgaaaggtagaaggaaaaccagcaagaagtgctctttctaaaagcagtaagaattaaaaggataattgacataagcacttaaaagcttatttgctgctgcttctggtcaccagaaagaaaatgcttgctcttaaataaatgagcaataaaaatccaaaaaatccaagttaaaaaatgtatatttggaaaaatggccgggcgtggtggctcccacctgtaatcccagcactttgggaggctgaggcgggtggatcaacttagatcaggagttcgagaccagcctggccaacatggcagaaccctgtctctactaaaaatacaaaaattagccgggaatggtggcacacctgcaatcacagctattcaggaggctgaggcaggagaattgcttgaacctaggaggtggaagtttcagtgagccgagatcgcaccattgcacttcagcctgggcaacagagtgagaccctgtctcaaaaaaaaaaaaaaagttggaaaaaaataatgcagcaataaaaaataatacaaatatagacaggtgtggcagcatgcacctgtagtcctagctacttgggaggctgcggtaggcagattgcttgatcccaggagttcaagtccagcctgggcaatgtagtgagaccctatctctaaaaataaatacaaatgaaaaacaatacagtataataattatttacatagcatttacactacattaggtattataagtaaacaagagatgacttaaagtatacaggaggatgtgtgtaggttatatgcaaatattacataattttatataaaggacttggacatcagtgggttttggtattaaagagatcctggaaccaatccttcatggatactgagagacgattatatctgcaaaggtgtagatgctaagaacaggtatccagggcctcccagagccagcctaggagtctgagctttatcc[131 bp omitted]ctggttcaagcaattctcctgcctcagcctcccaagtggctgggattacagacacatgctaccatccccagctaatttttgtatttttagtagagatgggtttcaccatg[137 bp omitted]aaagccattttatatagaaactcaccattgactcttctctgttacacccttaatccagtctcagcaaatcctgtcagctgtctcaaaaatgtttctcgaattcagtgctcatttcccccaccgtcgttcatctctcacttggattactgcaaaatccttcaaactcttcccccttcttctggccctgcccctctacagtttcttctcaacacagcagtcaatgaccctgttaaaacctaagcctgatcatgtcactgtatttagtggctcctttttatttttcatttttttgagactaagtcttgctctgtcacccaggctggagcgcagtggcatgatctcaggtcactgcaacctccacctcctgagttcaagtgattcctgtgcctcagcctctcaaatggctgggactacaggcacatgccaccacacccggctaatttttgtgtttttaatagagatgggggtgtatgttggccatgttggtcttgaactcctgagctcaagggatctgcccccttctgcctcccaaagtgctgggattgcaggcatgagccactgtgcctggcctatttagtggttcttaatggctcatttcactccagtaaatatctaagtgccccagcctgggcgacatagggagaccctgtcgctacgaaacgttaaaaaattagccggatgtcggggcacacacctgtggtctcagctattcaggaggctgaggtgggaggattgcttgagcccggaaggtcaaggctgcagtaagatgagatcacaccactgtactccagcctgagtaacagagcaagactctatctccaaaaaaaatataaaaagaagaaaaaaattaaagattcaagttctcacaacaggcatacgcttccacatcagccccttccacctcacctctgtgaccttatctcccactgctctcaccatcagttcactgggctttggccatactgggcagttctcagctcagggcctttgcacttgctcttctcgctacctggaagctcttcccctagatgtccccacgccttcatggcttccttcatcagtctccttaggtcttttttccaatgtcacctcagtgagg[135 bp omitted]tggtgaaaccccatctctactgaaaatacaaaaaattagctgggcatgatagtgtgtgcctgtaatcccagctactcaggaggcttagacaggagaattgcttgaaccgggactcgggaggtggaggttacagtgagctgagatcatgccactccactccagcctgggagacagagggacactctgtctcaaaaataaaataaagtaaaataaaataaaataaagtaaaattgcaaaccccaggtcgggcgcagtggctcacacctataatcccagcattttgggaggtcaaggcccagcattctgggcttgagcccagaagtttgagaccatcctgggcaacatggtgagacctccgcctctacaagaaaaatgcaaagattagctgggtgtggtggcacatgcctgtagtcccagctactcaggaagctgaggtgggaggctcacctgagcctggggagttcgaggctacagtcagcagtgattgagccactgcactccagcctgggtgacagagtgagactctctctaaaaaaaatttgcaacccctggcccccactcagcactccctacccctactactgctttatttttctccatattacttacctgagataacatatattttatttattgtttgactccctgcctagaatgtaagctccatgaggtcatggattgtgtattttgttcactgctgtattccctgagcctggaacagtgcctgacacatagtagatgcgcagtaaatatttggtgaatgaatgaacaaacgctaatacatcaaagagacaacatcaaagaacagactccacagggcagtttacatcttcattgtttggcccgacccttcttgtttgagggtggattttcaaaattactgctgaaggcaattgggagccttgaaagcttttaaagggtaagagtaagtggcaattatatatttgttgttgttgatgttgttgtttttggaggcagggtcttgctctatcaccccggctggagtgcagtggtatattctcagctccctgcaacccccacttccccggctcaagccatcctccaacctcaggcccctaagtagctgggactacaggtgcgtgctgccaacccaattttttgtattttggtagagacggggtc[132 bp omitted]ggccagctggagagtagatggggatggggacaatagtggaaacaagaaggctcgtgggggcggttgttaaaattatgcttttttttttttgaaacagagtctcgctcttgtcgcctaggctggagtgcagtggcacgatctcggctcactgtaacctccgcctcccaggttcaagcagttctcctgcctcagcctctggagtagctgggattacagacacctaccaccatgcccgctaatttttgtatttttagtagagacggggtttcgccatgttggccaggctggtctccaactcctgacctcaggtgatctgcccgcctcagcctcccaaagtgctgggattacaggcatgagccaccacgcctggtcagcaaactttttctgatagtaaatattttaggctttgcagatgacatacagtgtctgttgcgactactcaactctgctgttgcaggatgaaagctgcaggacaatatgtaaatgaacggtgtggctgggttccaagaaaactttagttacagatactaaaatttaaattcaatagaattgtcatgtgtcccaaaatattcttttgatttttttcaaccattcaaaaatacagaaaccattcttagctctcaggctgtacaaaaacacgcagtggccaggtttggtccataggctgtaatttgctgagcctaggcctagataattatgtcaagactctcctctccctcctcaaacctgcaacccttcttcctccattctcacactcagttgaggacctggcttcctagtcactgagaaaatttaagcaatcacaagagaactcccacagcccatccacacatgctatctgccaacacctccacgtgactattcccccatccctctgttactgtgaatgaaacgtttgaactatgtccggcctgtctgctcgcttgtgccctagatccaaacctctctcgcccattcaacaaccctgctctgactagtcttccctttctgtccttgctgttcactgcattattcccatcaacatacaaataaatatgctgtcatcttaaaaaagctgctttttactccaactcccttgccagctacttcttcttctccttccctttacaacaaaaccctggtaaagatttgtcttcattcactgtttccaacttctctcccattctttaagtgagatacaattcacgtaatatgaaaatcaccgtttttttattttattttatttttgagacagagtcttgctctgtcaggctggagtgcaatggcgtgatctcagctcactgcaacctcggcctcccgagttcaagcgattctcctgccccaacctcccaagtagctgggattacaggcatgcaccaccacacccagctaatttttgtatttttagtagaggcagggtttcaccatgttggccacgctggtcttgaactcctgacctcaggtgatctgcccacctcggcctcccagagtgctgggattacaggtgtcagccaccgcaccggccactattttattttattttatttatttttgagatagagtctctgtcacccaggctggagtgcagtggcatgaactcagctcactgcaacctccgcctcctgggttctagtgattctcctacctcagcctcccaagtagctgggattacaggcatgtgccaccacgcctggctaattttgtatttttagtggagatggggttttgccatgttggcccagctggtcttgaactcttgacctcaggtgatccacccgcctcagcctcccaaagtgctaggattacagatgtgagccaccgtgcctggcctagcagtcactctttcattcccactcttctctcagccctaggaaaccactaatctattttccgtctctgtggatttgcctattctggatattttatataaatggagacacaatatgtagccttttgtgtctgctttctttcacttagcataatgttttcaaggttcatccatgttgtagcatgaatcagtatttcattttttttagaagtggggtctcactatattgcccaggctggtcttgaactcctgagctcaagcaatcatcccaccttggcctcccaaagtgctagaattacaggtgtgaggcactgtgccaggccaacattttttattttttttaatagagacagggtctcactatgttgcccaggctagtctcgaactcctaagttcaagtgatgctcccacctcagcctcccaaatgctaggattacctggaagagctctcatgcccggctcatttttctttctctttctctttctttttttttctttctttctttcctttctcctttttttctttctttccttccttctttccttctttcctttccttccttctttccttccttcctccctccctcttctctctccctcctttccttccttttttccttccttccttctttcattcctccctccctccctctctccttccctctttccttcctccttccctccctctcactcttttccttgcttccttttctttctctttttctttttctttctctctctttctctttccctccctccctccttctctttccctccctccctccttctttcttttttctttctccttccttctttccttatttccttttccttccttccttcttctctttcccttcctttctccctccctcccttttctttctcttttctttccttcctttctctttctccttccttcctcctcctttttctctttctccctttctctccttccttccttctttccttttttccttccttcctttcttccctccctccctccctcccttttctttctttcccttcctccctccctccctttctttcctcttttctttctttttccttccttccttcctttccatttttttcctccttcctttctttcttcttgacagagtcttgctctcttgcccaggctggagtgcactggtgtgatcttggctcactgcaacctctgcctcctgggttcaagcaattctcctgacacagcctcctgagtagctgggaccacaggcttgtgccaacacgcctggctgacttttgtatttttaatattttttctttttttttttttttggtgtttatttttttgagacagagtctcagtctgtcacccaggcagcagtgcagtggcgcgatcttggctcactgcaacctccatctctcaggttcaagcaattctcctgcctcagcctcccaagtagcttggattgcagatgtgcactaccacgcccggctaatttttgtatttttagtaggggtggggtttcaccatgttggccaagctggtcttgaagtcctgacctcaagtgatcctcccgcctcggcctcccgaagtgctggcatttcaagcatgagccaccacgcccagccgtatttttagtggccaaccttgctggccactcctcctccttgaaacacttttctcttggattaagtaacaccggagtcttctggtatttctcctactctggctattctttctgtctttgtagatacatttccttacctctgtgtaatgttaagagttctttaaggctgggccctaggtctgcttctgttcctacttcactctctccccataaagtgacagaatccatggtcatgacttcaatggacccctaaaaatggatgaattccaaatccatacatccatttcccacctgccattcacccctcactataacatggtttctatctcttttaggtcatcagtttcattagttcactaatgaaatcacgactgccaaatccaatgaacacttccatttcttgtcttccttaatctctctgtggcatgggacaatgtcagccaatctccttcttgaaattttcccttcccttaatcctctcgcccatctgacagtcattcactttcaatcatttttggtggctcttgtacctccctcttgggctacttgtttctaaaagctgaggaaacaaagttatttagaaagtaaaggcaaagtgatgccatgttaggaagggctggcagaatgaatgaaaatcaggcaaaagctcaaggatgttgtctaaacattttgttcttaagggaccagaatagttgatgtggtttggatatttgtccccacccaaatctcatggaaatataatccccagtgttgtaggtggggcctggtggggtgttggggttatggggcagatccctcatggcttggtgctgtcctctccatagtgagttttacagagctggttgttgtaaagtgtggcacctcctccccgcactcactctcttgctcactctgtgatgtgggatgtcttctgcttcactttccaccatgagtaaaagctccctgaggctttcccaaaactcgagcagataccagtgccacacttcctgtacagcctgcagaactgggagccaattaaatctcttttcttataaattatccagtctcaggtatttatttatttatttatttatttatttttctgaggcagagtctcattctgttgcccaggctggagtgcagtggtgtgatctcggctcattgcagcctccaccttcctgggttcaagtgattctcctgcctcagcctcctgagcagctgggattacaggcacctgccaccatgcctggctaatttttgtatttttagtagagatggggtttcatcattttggccaggctggtctcaaactcctgacctcaagtgatccgcccatctcagccttccaaagtgttgggattacaggcgggagccactgcacctggccaggtattttttttttttctttttttgagatggagtctcactctgtcacccagactggagtacagtggcacaatctcggctcactgcaacctccacctccctggttcaagtgattcttctgcctccgccttctgagtagctggggactacaggcgtgtgccaccacgcccagctaattttttgtatttttagtagagatgtggtttcaccatgttggccaggctggtctcaaactcctaacctcgtgatccacccacctcagcctcccaaaatgctgggattacaggcatatgccactgcccccagccccggccaggtatttctttataataatgtaagaacagcctgtattagttcg[133 bp omitted]aattcccatctctactaaaaatacgaaatttagccaggcacggtggcggatggctgtaatctcagctactagggaggctgaggcaggagaattgcttgaatctgggaggtggaggtttcagt[131 bp omitted]cacatgggtagggaggccccacaattatggcagaaggcaaggaggagcaagtcatgtcttacatggatggcagcaggacaaaaagagcttgtgccggggaactcctctttatgaaaccatcagatcttgtgagacttcttcactatcatgggaacagcacaggaaagacctgccccattattcaattacctctcactgggtccctcacacaacatgtaggaattcaagatgagatgtgggtgggggcacagccaaaaaacatcaggcctaatataggagtgaaccatgaactgatttttccctggtagacaaaacaaaggcatgccagtgaaagcagaaactaatatcattcatgcacttttgaaattctccagaggttaattcagtatcaaaaatttaatttctcaaatataacagctatttagtgaagttaataaacacacttagcttcatacttgaatgttgttactatttattgacatcaaaacaaaacaagctgagactaaaagttgctatttaacaggaacagacattgatgcagtttccttcctggagagggtacacactcagatcatgagacctaagataaaacacacactggattgtcaagaatcaaacaaggactaccaatgggatctaattaaactaaagagcttctgcacagcaaaagaaactaccatcagggtgaacaggcaacctacaaaatgggagaaaattttcgcaacctactcatctgacgaagggctaatatccagaatctacaatgacctcaaataaatttacaagaaaaaacaaccccatcaaaaagtgggctaaggacatgaacagacacttctcaaaagaagacatttatgcagccaaaaaacacatgaaaaaatgctcatcatccctggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttactgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactattgcaagaacaaaaaaccaaacaccgcatattctcactcataggtgggaattgaacaatgagatcacatggacacaggaaggggaatatcacactctggggactgtggtggggttgggggaggggggagggatagcattgggagatatacctaatgctagatgacgagttagtgggtgcagcacaccagcatggcacatgtatacatatgtaactaacctgcacaatgtgcacatgtaccctaaaacttaaagtataataaaaaataaaaaaagctgaagataaaagcagatgtttgaaaatattcttcatgctaagctcatgtaagcaaacaaaaaactaaaagtaatccttaaactttaggacattagatgcagaagtaacatgactatttaaattttggcaccaacaaaagtttgttctatccttcactgtacttatactacaaggacatgcttgttgcttctacacttcccaaagtcaacagttatcatcaacaatgcaataaaactagattggaatggacgggcacggtggctcatacctgtaatcccagcactttggaaggccgaagcggggggaatcacctgaggtcaggagttcaagaccagcgtggccaacgtggtgaaaccccatgtctactaaaaatacaaaaattagccaggcaaggtggcgggcacctgtaatcccagctactcgggaggctgaggcaggagaatcagttgaacccaggaggtggaggttgcagtgaaccgacattgagccactgtactccaggctgggcaacagggtgagaccctgtctaaaaaaaaaaaaaaaaaaaaaaaagaaaaaaaaaaaagaaaattcaactcgggatgaacaacagcttttgattttagaaccagctcttacttttctctcgtgtcatacgtaatgaagtcctcacttgacatttccctgcaaattgcaatgcatgtcctcaccatcagctttttctgacactaaaattaatttgtataaattgcaaaagcaatgaaattgtacttccaattctgaacctctgatcagattcctgctttgacacaagacttactcctctgcagtgtaccccaccagcacaaccaccccctttctctctattctttgccctgaaggcacttctggattgcttaacgtgtgctctttggctgcctagacagtcagtacacctaaggccatctggacttaacactcccttcctccttcttttctatggttaatatcactttcctgctttctttctactgctgaatctccagattggtgctgccatcttgccaccagaatcgacctgggcttcgagctcctggatggtaaagcttcatccctggatgatcctgaagtataatgaaatatgttactgttagaacaatgctaatatgctttaaatgggattatcaggtcatatcttatatatattaatatatactaaagctcagtaatttaagaccaaaaatgtgagggcatggtaaatgacaacttgcccatttcctctctccatctccaaagaaaagcaaccattttataattattattttataagcctggttcagtttcttttttttcagagatatcatctcactgtgtcacccaggctgaagtgcaagtggcacaattgcagctcactgcagcctcgacattccagactcaagcgatcctcccacctcagctccctagtagctgggattgcaggcaggtgcaaccacactgggctaagtttttaaatttttagtagagagggggtctccctatgttatccaggcgggtcttgaactcctgaagttaagtgatcctcccgccttggcctccgaaatgctaggagacggggtttcgccatgtaggcccagctcgtctccaactgctgacctcaagttatctgcctgcctcagcctcccaaagtgctgggcttatagggatgagccaccgtgcctggcctatagttattaaggacatgaaattatgctttatgaggaagtggtcctcacccccactgcctacaacacaagaaaggagaggaagggagcaaactagaagaagaaaggtggtattgggggaaaggatatcaattaaagatggattttaaaaattgcttcgcaggagggagggccctcctgtggtttcactggttgatctggctgagggattttctccagcgacacttgcagcttaggggcaagaggctcccacaacaccctgtgctacctcgacccttctgacattgtgcatcatgatctgattattgctatttgcctcttgccaatattgaaccatgagttcaacacagacaaggacttattttaatccttgaccccagggccgggcacacagtcagtgattggtacatgtttgctaaatgaatgagcaaatggaagaaattgaagagggtggggtggggacgtgtggtttatccagagctggacaggcaaggcaagtagaacagaagagggaggtgctgacgtgaaaacggccttgagatggctggcaacaggctagacaaagaggcaagggatgtcagctcatgcctggtggttcaggagaatggcttctcttaaggccaactcctctaacctctatcttggcttccattttcacctgcctttgcaggaagcctacagtattagtagtctctttctcttgggtattcattcttttagagctttccttttggcttctaaacttactttctcatatttaaaataatgcttcattaacaccattaacctatgtatctcaatttctttcacagctgtgttagtctgttttcacagtggtagaaagaaatacccgagactgggtagtatataaagagaagagatttaattgactcacagtttcgaatggctcgggaggcctcaggaaatttaaaattatggcagaaggtgaagcaggcatgccttacatgacagcaggcgagaggtgaattgcgagtataggaaaaactgccacttttaagaccatcagatctggtgtgactcactcattatcaggagaacagcatgagggaaaccagcctcctaatccaatcacctcccaccaacttcctcccttgacacataaggattacaattcaagataagatttgggtggggacacagagcccaaccatatcaacagccatatgagaagtcttcaaaaagtccatggaaaatgtgtattatcaagaaactgtgcatggattgcaaaatctttttgagggctgggcatggtgactcacccctgtaatcccagcactttgggaagctgagactggtggatcacttgaggtcaggagtttgataccagcctggccaacatggtgaaacctcgtctctactaaaaaacagaaaaattagccaggtgtggtggttcacacttgtattctcagctactcaggaggctgagggaggagaatagcttgaactggggaggtgaggttgcaatgagctgagatcgcgccacagcactgcagcctgggcgacagagtgagactccatctcaaaaacaaaatctttttgcaccaaaacaaactggtactaacgcattataaaatgtctcaacaggatctagtttgagtcattaaaaaggagaagtcatcagtttgaaaagagctacaatcagagcaaaatgaattctgctaaaattgaaggaacaacaaacgtcaaatttagggtgaggttagggtggaagaatggtaaaatcactgatgctttaccaaaagtttatggggacaatgcacctaaataaatcagcagtttataaaaatagttaatttgtaagaaaggacaagacgatgctgaagatgaagcctgcagcagcaggtcatccacatcaatttgtgagaaaaaaaatttatcttctttgtgccctaatttggaaggaccaacgattaacagcagaaacaacagtcaacaccatagacatcacaattggttcagcttacagaattctgactgaaaaatcaaaagttgagcaaactttccacttgatgggtgccaaaaccagatcagctgcaaagaacagagctttcaatggaaattttaaacaagtaggctctattggttgctacaaaattaattgcagtttttgccattgaaagacatgtcaaaaaccgcaattacttttgccccaaccaatagatcatgaagcatctattgggaaagtgtaacaggaggtgaaatgtggctttccaactatggagacaaagtacaatcgaagtaatggctccgaagatgtggaagtggtccagtcaaagcaaaagtggtctggtcaagagcaaaggtcatggaaatagttttttgagctgcttgagaaattttgcttgttgactttctggagggccaaagaaaaataacatctgcttattatgagagtgttttgagaaagccaaagctttagcagaaaaatgcccaggaaaacttcaccagagagtccttttctatcacagcaaaggttctgctcacgcctctcatcaaacgggaaattttgagagagtttcaatgggaaaccagtaggcattcaccctacagttggtatttagctccttccaacttcttttggtttcctaatgataaaaaatctgtaaagggtaccattttttttccagttaataatgtaaaaaagattgcattgatgtaaattcccaggaactccaattctttggggatggataaaatggctagtatctaagtgctgtgagcaagagacaaaaataaataaataaatggctaatatcattgcctacaaaagtgtcaaagtttcttgaccttggtggatcttataagtttatattttttatcttttacgtctattttccacaaacttttttttttttttgagacagagtctggctctgtcacccaggctggagtgcagtgacgtgatctccgctcactgcaacctccgcctcccgggttcaagcgattctcctgcctgagcctcctgagtagtttgtactacaggtacgcgacacaacacacagcaatttttttttctatttttttagtagaggtggggttttgccgtgttggccaggctggtcttgaactcctgacctcaggtggtccacctgcttcggcctcccaaaatgctgggattacaggagtgagttactgc[211 bp omitted]gaggcaggagaatcacttgaaccccggaggcagaggttgcagtgggcaaagatcgtgctgctgcactccagtctggtgacagagtgagactcagtctcaaaaaaaaaaaaaaaaaatccctcaggctggacacggtggctcatacctgtaatcccagcactttgcgaggctaaggtgggcggattgcttgagcccaagagtttgagatcagcctgggcaacatgggaaaaccctgtcttgacaaaaaatacaaaagttagctgggcatggtggcctatgcctatattcccagctactcaggaggctgatgtgggaggatcaactgaacccagaaggtcaaggctgcagtgagccgtgattgtgccatggcactccagtggtggtgacagacagaaaccttacctcaaaagaaaaaaaaaaatccaggctgggcccagtggctcatgcctgtaatctcagcccattgggaggtttaggtgtgcacatcacttgaggtgaggaattggagaccagcctggccaacatggtgaaaccctgtctctacaaaaaatacaaaaattagccatgtgtggtgccaggcatctgcaatccagctacttgggaggcagaggaaggagaatttcttcaactcaggaggtggaggttgcagtgagccaagatggcaccactgcactacagcctgggtgacagagcaagactctgtcttaaaaaaaaaagaaaaaaatccacctaggaactaattgcaagccatgattctttctgataattacatatttatatgttcaggagaatgtgaaggaggcctcagagtagaactaagggtccagaaacttttgaagatccctcgtacttccctaaaaagttgtatatatcttttccattctcaacccaatctggcttccctgccccataattctagggcatcagtgatttgcaagtcactgaatgccatggcttttgtcaggcatcataattgaccattcagcggcatccaaccctgctggccactcctcttccttgaaacacttttctcttagattaagtaacccagagtcttctggtttttctcctactctctggctagtccttctctgtttttgtagatacatttctttacctctatgtaatgttagtttttcgaggttgggccctaggtctgcttctgttcttacttcactctccctcttaagtaacagaatcaatggccatgacttcaatgaccacctaaaaagagatgaattccaaacatacatccatttcccacctgccattcacccctcactgtaacatggtttctgtctcttttaggtcatcagtttcattagttcactaatgaaatcacgactgccaaatccagtgaacacttccatttcttgtcttccttagcctctctgtggcacgggacattgtcagccaatctccttctagaaattttcccttcctttagtactcttgcccagttgacaatcatttactttcagtcattattggtggctcttgtacctgcctctttggctatttgtttctaaaagctgggaaaacataaagtggtgattaagaaagtaaaggcgaactgatgccacgtcaggaagggctggcagaatgaatgaaaatcaggcaaaagctcaaggatgttgtctaacattttgttcttatgggacaagaatagtggatgtagtttggatatttgtccccacccaaatctcatggaaatataatccccagtgttgtaggtgggtcctggtggggtgttggggttatggggcggatccctcatggcttggtgctgtcctctccatagtgagttcttacagagctggttgttgtaaagtgtggcacctcctccccgcactcactctcttgctcactctgtgatgtgagatggctgctcctgctttaccttccgctatgagtaaaagctccctgaggcctcccagaagctgagcaatgtgagattcccgacttgtacagcctgcagaactataagccaattaaacctcttttatttttttcttttctttttttttttttttgagatggagtctcgctctgtcacccaggctggagtgcagtggtgctatcttggctcactgcaacttctgcctcctgggttcaagcgattctcctgcctcggcctcccgagtagcttggattacaggagcgtgccaccatgcccggttaatttttttgtatttttagtagagacagggtttcaccatgttggccaggctggtctcaaactcctgacatcaagtggtcatcccacctcagcctcacaaagtgctgggattacaggcatgagccaccgtgcctggccaaacttcttttcttatcaattacccagtctcaggtgtttctttttagcagtgcaagaatggtctaatacaggagtgaaccatgaactgatcgttctctggtggacaaaacaaaggcatgctagcgaaggcagaaactaatatcattcatctgctttccaaactccaaagaggttaattcagtatcaaaaaattaatttctcaaaattcacagctgtttgctaaagttactcactacacttaacttcatacttgaatgctgttactatttattgacatcaaaacaaaacaagctgagactaaaagttgctatttaacaggaatagacatcggtgcagtttccttcctggagagggtaggcactcagatcatgagacctaagatcaaacaaactagattgtcaagaatccaacaaggactacattttacctcttaataaaaaaaatgctggagacaaaacaagatgtttaaaaatattcttcatgccaagcttagataagcaaataaaaaactaaaactaatcctaaaacttgaggatattggatacggaagtaacatgactatttaaatgtttgcatcaatgaaagtttgttctattcttccctgtacttgtactacaaggacatgcttgttgcttctatactacccaaagtcaacagttatcatcaacaattcagtagaaatagatcagaacaagacttcaaagcgactctgctccaccaaaatttagaaactcaatttgggatgaacaaaagcttttgattttagaaccagctcttacttttctctcatgtcatatgtgatgaagtcctcacttgacatttccccctgcaaattgcaatgcatgtccttgccatcatctttttctgacactttaatttatagaaattgcaaaagcaatgaaattgtacttccaattctgaacctctgatcagattcctgctttgaggcaaaacttactcctctgctgcacactcctctactcttttctttctttcttttttttttttttttttttttttgagatggagtcttactctgttgcccaggctggagtgcagtggcaagatcacggcttactgcaacctccgcctcctgagttcaagcgattctcctgcctcagcctcccgagtacctgggactacaggcacctggcaccacgcctggctagttcttgtattttcagtagagatggggtttcaccatgttgaccaggctggtctcaaactcctgacctcaggtaatccacccgcctcggcctcccaaggtgctgggattacaggcgtgaaccatcacacccagcctctcctcttcttttgtatggctaatacaactttcctgctttctttctactgctgaatctccagacttggttatgtcatcagggtgcgagagtcgaccttggcttcgagctcctggatggtaacgctgcatccctggatgattctgaagtacaatgaaatatgttactgttacaacaatgctgctaagcttttacgtgggattttcaagtcataacttatatattaatatatactaaagtccagtcatttaagaccaaaaatgtgaaggcatggtaaatgacaacttgcccacttcctctctccatttccaaagaaaagcaaccatttcctaattattattttataagcctggtacaacttatttttcttagagacatggtctcattttgtcactcaggctgaagtgcaaatggcaagattgcagctcacaacagccttgacattccagactccagccatcctcccacctcagcttcctagtagctggaattgcaggcacgctctaccacactgggctaagttttaaaatttttaatagagatggggtctccctatgttatccgggctggctttgaactcctgaagttaaatgattctgccaccttggcctcccaaatgctaggattgcctgcatagacgaagtttcgctctggttgtccaggttggagtgcagtagtgcaatctcggctcactgtaacctctgcctcccgggttcaagcgattctcctgcctt[213 bp omitted]tatgaggaagtggtcctcaccccccttgcctgcaacacaagaaaggagagcaagggagcaaagtagaagaaaggtggcactggggaaaggatatcaattcaagactgatggtaaaaattgcttagcaggagtgaaggctctcctgtggtttcaccaattgatctgcttgagggattttctccagcgacacttgcagcttaggggcaagaggctcccacaacaccctgtgctaccgcgacccttctgacattgtgcatcatgatctgattattgctatttgcctcttgccaacactgaaacatgagttccacgtgcacaaggacttatttgaatccctgaccccagggcctggcacacagtcagtgattggtacatgtttgctaaatgaatgagcaaatggaagaaattgaagagggtggggtggggatgggtgatttatccagagctggacaggccaggcaagtagaacagaagagggaggtgctgacatgaaaacaggctagacaaagaggcaaggatgtcaactcatgcctgggggttcaggagtgttgcttctcctaaggccaactcctctaacctctaccttggcttccattttcacctgcctttgcaggaagcctacagtattcgttgtctctttctcttgagtattcatccttgtagagcttaccttttggcttctaaacttacttactttctcatatttaaaataaagcttcattaacaccattaacctatgtatctccatttctttcacagctatattaattggttttcacactagtagaaaaaatacccaaggctgggtaatatataaagagaagaggtttaattattttattttatttttatttatttataaaataaataaaatatgtgacgtagtctcgctcttgtcgcccaggctggagtgcaatggtgcgatctcggctgaccacacttctgcccttcaggtttaggcgcttctcctgcctcagcctcctgagtagctagaattacaggcgggcataagcacacccagctaatttttgtatttttagtagagatgggtttcgccatgtttgcctggctggtctggaactcctgacctcaggtgatccaccggccttggtatcccaaagctgggattacaggggtgagccaccaagcccagccgaagaggtttaattgactcacagttccacatggctgggggagcctcaggaaacttacaatcatggcagaaggggaagtggacacatgctacatggcagcagactagaggtgaagtgcgagcataggaaaaactgccttgtttaaaaccatcagatcttgtgaggcttactcactatcacaagatcagcatgtgtgagactgccccaataatccaatcacctcctaccaagctcctcccttgacacatgaggattacagtttaagatgagatttgggtgcgggaacagagctcaatcatatcaacagtcatatgagaagtcttcaaaaagtccatggaaaatgtgtattatcaagaaactatgcatggattgcaaaatcttttggcatcaaaataaactggtactaactcgttaaaaaatatctcgacaggatctagtttgaggcattaaaaaggagaaagcatcagtgtgaaaagagctcctatcagcgaaaaatggattctgctaaaattgaaggaagaacaaacataaaatttaagatgaagcttgggtggaagaacggtaaaatcactgatgctttaccaaaagtttatggggacaatgcccctaaagagatcagcagtttacaaatggataacttgtaagaaaggacaaaatgatgttgaagatgaagcctgcagcagcaggtca[210 bp omitted]gaggcaggagaatcgcttgaacccaggaggcggaggttgtggtgagctgagatcatgccactgcactccaacctgggcaacagaatgagactccgtcttaaaaaacaacaacaacaaaaatcctcttcgtgctttaactgaaaagcatcggctgggtgtggtggctcacccctgtaattccagcactctgggaggccaaggcgggcgggtcatctgaccaacctggcccacgtggtgaaaccctgtctctaataaaaatacaaaaattaactgggtgcggtggcaggtgtctgtaattccaactacttgggaggctgaggcaggagaatcattgaacccgggaggcagaggttgcagtgagccaagattgtgccactggcctccagccttcgtgagagactaagaccaactattaatggcagaaacaacagccatcaccatagacatcacaattggttcagcttacacaattctgactgaaaaattaaaagttgagcaaactttccacttgatgggtgccaaaaccagatcagctgcagacaagaacagagatttcaacggaaattttaaacaagtgagatctattacgttgctgcatattaattgtggtttatgccatggaatgtcaaaagccgcaattacgttggcaccaaccaatagatcatgaagcatctattgggaaagtgtaacgggaggtgatacgtggctttcccagtatgactctgaagacaaagcaatatcaaagcaatgactctgaagaggtggaagagatccagtcaaagcaaaactggactggccaagagcaaaggtcatggcaatagttttttgagctgcttgagcaactctccttattgactttctggagggccgaagaatagtaacaccagcttttttttttttttttttgagaccaaatctcactctgtcacccaggctggactgcagtggtgcaatctcggctcactgcaacctctgcctcccaggttcaagctgttctcctgcctcagcctcctgagtagctgggattacaggcacgcaccaccacgcctggctaatttttgtatttttagtagaaacgaggtttcaccatgttggtcaggcttgtctcgaactgctgacctcgtgatcctcccatctcggcctcccagagtgctgggattacaggcatgagccaccgtgcccggccaacacctgcttattataagagtgttttgagaaggccaaagctttagcagcaaaatgcccaggaaagcttcaccagagagtccttttctaccacggtaatgcttctgctcgtgcctctcatcaaacaagggcaattttgagagtttcaatgggaaaccattaggcatccaccttacagtcgggatttagcttcttctgtcacttttttgtttcctaattttaaaaagtctgtaaagggcaaccatttctcttcagttaataatgtaaaaaagatttcattgatgtggttaaattccaaggacctccacttcttaggggatggatgaaatgactagtatgtaattgttgtgagcaagagacatacatacatacataaatggctagttatcattgcttatgaaagtgtcttgaccttggtggatcttacgatgagaagtttatatttttttcttttatttctattttccacaaacttttcttttctatttttccttttttttttttttttttttgagatggagtctggctctgtcgcccaggcaggagtgcagtggcacgaccttggctcactgcaatctccgcctcttgggttcaaacgattctctagcctcagcctcccgactaactgggattacaggagcccgccactgtgcctggctaatttttgtatttttagtagagactgggtttcaccatgttggccaggtttgtcttgaatccctaacctcaggtgaagtgcccgccttggcctcccaaagtgctgggactacaggcatgtgccacctcaatcccctgcctttttgttgtggggaggatggagtctccctctgtcgctcaggcaggagtgcagtggtgagatctaggctcactacaacctctgcctcccgagttgaagtgattctcctgtctgagcctcctgagaagtttggactacaggtgtgctccaccaagcccggccaaattttttttttgtattttttggtagagatggggttttaccatgttggccaggctggtctcaaactcctgacctcaggtgatccacctacctcagcctcccaaagtgctgggattacaggcatgtgccaccaagcccggcctttttttgggtgtggtggtgaggggggcagatggagtctaactctgttgctcaggcaggagtgcaggattgagatctctgctcactggaacctctgccactcaagttcaagtgattctcctgcctgagcctcccgaggagtttggactacaggtgcgctccaccaagcctggccaatttttttttttttgtattttttggtagagatggagtttcaccatgttggccaggctggtctcgaactcctgacctcaggtgatccaaccgcctcagcctcccaaagtgctgggattacaggcatgagccactgcccctggcttctgttcttttaaaaatccatataaagctggacacggtggctcatgcgtataatcccagcacttttcgaggctacagtggacagattgtttgagcccaggcatctggcaaacagatgccatgttaggaagggctggcaggatgaatgaaaatcaggcaaaagctcaaggatgttgtctaaacattttgttcttatgggaccagaacagttgatgtagttttgaaatttgtccccacccaaatctcatggaaatataatccccagtgttgtaggtggggcctggtggggtattggggttatggggcggatccctcatggcttggtgctgtcctctccatagtgagttcttacagatcaggttgttgtaaagtgtggcacctccttcccacactcactctcttgctcactctgtgatgtgacatgcctgctcctgcttcactttccgccatgagtaaaaggtccctgaggcctcccagaagctgagcaatgtcagatgccatgcttgtacagcctgcagaactgtgaaccagttaaacctcttttcttataaactacccagtctcaggcatttatttatagcaatgcaagaacggcctaatacaggagtgaaccatgaactgatctttctctggtggacaaaacaaaggcaatgcctgtgaaggcagaaactaacattattcatctgcttttgatacttccaagaggct[137 bp omitted]tggtgagacccccatctctactaaaaatacaaaaaattaaccaggcgcggtggcaggtgcctgtagtcccagctactcaggaggctgaggaaggagaataatttgaacccggagggtggaggttgcagtgagccgagattgtgccactgcactccagcctgggtgacagagtgaaactctgtctcaaaaaaaaaacaaaaaaaacaaaaaaaacctcacagctgtttactaaagttactcaccacacttagcttcatacttgactgctgttactatgtattgacatcagaacaaaacaaactgaaactaaaagttgatatgtaacaacaacagacattggtgcagtttccttcctggagagggtaggcaccagatcatgagacctgagataaaacaaactagattgtcaagaatccaacaaggactacattttacctcttaatagaaaaaatgctggagacaaaacgagatgtttaaaaatattcttcatgctaagcttatgtaagcaaataaaaaaacaaaagtaaccctaaaatgttaggacattggatacagaagtaacatgactatttaaatgtttgcatcaatgaaagtttgttctatccttccctgtacttatagacaaggacatgcttgttgcttctacactacccaaagtcaacagttatcattagcaatgcaatagaaatagatgggaataaagcttcaaagcgactctgctccaccaaaatttagaaattcaattcaggatgaacaacagcttttgattttaaaaccagctcttacttttctctcgtgtcacacgtgatgaagtcctcacttgacatttcccctgcaaattgcaatgcatgtcctcgccatcagcattttctgacactttaatttatagaaattgcaaaaacaataaaattgtacttccaattctgaacctccgaccagattccttctttgagacaaaacttactcttctgctgcgtactcctctcctctttatttttttttaatttttttggagatagagcctccctagtgtcacccaggctagagtgcagtggcacgatcatggcttactgcaacctccacctcctgagtttaatcaattctcctgcctcagcctctcgagtacctgggactacaggcgcctgccaccaagcccggctaatttttgtagttttagtagagactgggtttcaccatgttggccaggctggtctcaaagtcctgacctcaggtgatccacccatatcggcctcccaaaatgctgggattacaggcatgagccaccacgcccggcctctcctcttcttttctatggctaataccactttcctgctttctttctactgctgaatctccagacttgtcatcagggtgccagagtcgacctcggcctcgagctcctcgatggtaacactgcatccatggacagtcctgaagtacaatgaaatatgttactgttacaacaatgctactaagcttttacatgagatttttaggttataccttatatattaatatatactaaagcccagtcatttaagaccaaatatatgagggcatggtaaatgacaacttgcccacttcctctctccatctccaaagaaaagcaaccatttcctaattattattttttatgtctggttaaatttattttctttggagacagggtctcactgtgtcagccaggctgcagtgcaagtggcatgatccagcttcgacattccagactgaaggaatcctaccacctcagctccctagtagctgggatcgcaggcccgtgctaccacattgggtttttaaattttagcagagacggggttgccctatgttgcccaggctgttctagaactcctgaagttaaatgatcctcctaccttggcctcccaaatgctagggttacctgcaggagccatcacgcctggcccatttcttttctttttttcctctttttttttttttttttttgtctgagacagagtcttgctctgttgcccagactggagtacagtggtgtgatctcggctcactgcaacttctgcctccccagttcaagcgattctcctgcctcagtctcccaagtagctgggactacaggcatgcgccaccatgcccggctaatttttgtatttttagttgggacagggttttaccatgtttttcaggctgatctcacactcctgacctcaagtgatctgctcgcattgacctcccaaagtgctgggattataggcatgagccaccaacactggccccaggcttgtcttgaactcctggcctcaaagtgatcctcttgccttggcttcccaaagtgctaggattacaagcatgagctatggtgcctggcctatagttattaaggatgtgaaattatgctttatgaggaagtggtcctcacccccactgcctacaacacaagaaaggagaggaagggagcaaactagaagaagaaagatggtattgggggaaaggatatcaattaaagatggattttaaaaattgcttcgcaggagggagggccctcctgtggtttcactggttgatctggctgagggattttctccagcgacacttgcagcttaggggcaagaggctcccacaacaccctgtgctacctcgacccttctgacattgtgcatcatgatctgattattgctatttgcctcttgccaatattgaaccatgagttcaacacagacaaggacttattttaatccttgaccccagggccgggcacacagtcagtgattggtacatgtttgctaaatgaatgagcaaatggaagaaattgaagagggtggggtggggacgtgtggtttatccagagctggacaggcaaggcaagtagaacagaagagggaggtgctgacgtgaaaacggccttgagatggctggcaacaggctagacaaagaggcaagggatgtcaactcatgcctggtggttcaggagaattgcttctcttaaggccaactcctctaacctctaccttggcttccatttacacctgcctttgcaagaagcctacagtatttgttgtctctttctcgtgggtgttcatccttctagagctttccttttggcttctaaacatactttcttatatttaaaataatgcttcattaacaccattaacctatgtatctccatttctttcttttttttttttttttttttgagatggagtcttgctctgtcgcccaggctgaagtgcaatagcatgatctctgctcactgcaaccgccgcctcctgggttccagcaattctcctgcctcagcctctcgagtagctgggactacaggtgtgcaccaccatgcccggctaatttttctatttttggtagagacggggtttcaccatgttggccgttctggtctcaaactcctgacctcaggtgatccaccggccttggcttcccaaagtgctaggattacaggtgtgagtcactgcgcccagccgtatctccatttctttcacagctgtattagtccgttttcacactggtagaaagaaatacccgagtgtgggtaatttataaagaaaagaggtttaattgactcacagttccacatggctgggggagcctcaggaaacttacaatcatggcagaagggaaagcgggcatgtcttacatggcagcagactagaggtgaagtgcgaacataggaaaaactgccttgtataaaaccatcagatcttgtgagacttactatcacaagatcagcatgtgggagactgcccccataatccaagttcctccctagacacatgaggattacaattcaagatgagatttgggtgggtatacacagccaaactatatcaacagccatatcagaagtcttaaaaagtccatggaaattgtgtattatgaaaaactatgcatggatttcaaaatctttttgcaccaaaataaactggtactaattcattataaaatatctcaacaggatctagtttgaggcattaaaaaaggagaagtcatcagtttgaaaagagcccctatcagaacaaaatgaattctgctaaaattgaagcaagaacaaacatcaaatttagggtgaagcttgggtggaagaatggtaaaatcactgatgctttaccaaaagtttatggggacaatgcacctaaaaaaatcagcagtttacaaatggataacttgtaacaagggaaaagatgacgttaaagatgaaggctgcagcagcaggacatccacatcaatttgcaaggaaagaaattaatcctctttgtgccctaactgaagagtcagccaggtgtggtggctcatgcctgtaataccagcactctgggaggtcaaggcaagtggatcacttgaggtccagagtttgagaccagcttggccaacctggtgaaatccattctctactaaaaaaatacaaaaattagccattcatggtggcgcacgcctatagtcccagctactcgggaggctgaggcaggagaatcgcttgtgcccgggaggcggagcttgcagtgagccgagatcgtgccactgcactccagcctgggtaacagagtgagactctgtctcaaaaaaagaaaaggaccaacgattaacagcagaaacacggccagatgcggtggctcatgcctgtattcccagcactttgggaggtctaggtgggtggaaaaactgaggtcaggagtttgagaccggcctcgccaacatggtgaaaccctgtctctactgaaaatacaaaaactagccgggcctggtggtgcgtgcctataatcccaggtactaggggaggctgaggcaggagaatagcttgaacccaggaggcagaggttgcagtgagtcgagattgccccactgcactccagcctgggcgacagggcgagtccacgtctcaaaaagaaaaaaaataaacagcagaaacaacagccaacaccgacatctctattggttcagcttacacaattctgactgaaaaattaaaagttgagcaaactttccacttgatggctgccaaaaccagatcagctgcagacaagaacagagatttcaatggaaattgtaaacaagtgggatctattaggttgctgcaaaattaattattgtttttgccattgaaaggaatgtcaaaaacagcaatgacttttgctccaaccaatagatcatgaagcatctactgggaaagtgtaacaggaagtgatacgtggctttcccagtatgactctgaagacaaagcactatcaaaacaatgactccaaagaggtgaaagtgatccagtcaaagcgaaatggactggccaagagcaaaggtcatggcaatagctttttgagctgcttgaggaattttacttgttgactttctggaggaccagaaaataataacatctgcttattatgagagtgtcttgagaaagttagctaactctttagcagaaaaatgcgcaggaaagtttcaccagagagtccttttctaccacggcaatgctcctgcttatgcctctcatcaaacaagagcaattttgagagtttccatggaaaaccattaggcatctacctcacagtcaggatttagtaccctctgacttctttttgtttcctaatcttaaaaaatctgtaaagggcaaccatttctcttcagtaaataatgtaaaaaagatctcattgatgtggttaaattaccacgatctccaattccttggggatggatgaaatggctagtatctaggtgctgcgagcaagagacaaaaataaataaatatataaataaatggctagtatcactgcttacaaagtgtcttgaccttggtggagcttatgagaaatatatatatatacacacaaacacgcacccatatatatatattttcgagacggactctctgttgcctaggctggagtgcagtggctgggttcaagcgattctcctgcctcagcctcctgagtagctgggactacaggtgcaccaccacgcccagctaatttttgtatttttaatagagacagggtttcaccatgttggccaggatagtctcggtcttttgacctcgtgatctgcatgcctcggcctcccaaagtgctgggattgtaggcgcgagctaccgcgcccagccttttatttctactttccacacactcttgggttttttttcctcttctttatttttttgagatggagtctcacagtgtcacccaggctggagtgcagcagtgcgatctgagctcactgcaacctttgcctccgggttcaagcaattctcccacctcagcctcccgagtagctgggattacaggcacccaccatcatgctcggctaattttatttttttatatttgtagagatgaggtttcaccatgttggccaagttggtctggaactcctgacctcagatgatccgcctgcctcggcctcccaaagttctggtgttacaggtgtgacgccgtgcccgaccttttttttttttcttttttcaggttttcttcttttttcgagccggagtctcgctctgttgcccagactagagtgcagtggctcaatattggttcactgcaacttctgcctcacaggttcaagcggttctcctgactcagccttccatgtaattggagctggaaggaaaggcacatgccaccatgcctcgctaaattttttttgtattgtttagtagagaccaggtttcaccac[136 bp omitted]ggctcatgcctgtaatctcagcactttgggaggctaaggtgggcagattgcttgatcccaggagtttgagaccagcctgggcaacatgggaaaaccgtatctctacaaaaaatacaaaaagtagctgagtgtggtgtcacatgcctgtaacctcagctactcaagaagctgtggtgggagaatcaactgagcccagaatatcaaggctgcagtgagccgcgactgtgccactgcactccagcttgggtgacagagggagtctttacttaaaaaaaaaaaaaaaaaatctccttataggaacttactgcacatcatgattcattctttctttttttgagacagagttttgctcttgtcacctgggctagagtgcagtggtgccatctcggctcactgcaacctctgcctcctgggttcaagcgattctcctgcttc[134 bp omitted]ctgcctccaaaagtgctgggattacaggcgtgagccaccatgcctagccaattctttcttttttttctgagatggagtctcactctgtctcccaggctggagtgcagtggcacaatctcggcttactgcaatgtccgcctccccggttcaagcgattcttctgcctcagcctcctgagtagctgggactacaggcgtgcgccatcatgcctggctaatttttgtatttttagtagagatgggctttcaccatattggccaggctggtctcaaactcctgacctcgtgatctgcccgccttggcctcccaaagtgctgaattacaggcgtcagccaccctgcctggtgattctttcttataattatactttgatatgttaaggataatgtgaaggaggcctcaaagtagaactaagggtccacagacttttgaagttcccttgtacttctctaaaaagttgtatatattgtttccttcctcaacccaatctggcttccctgtcccataattgtaggtcatcaatgatttgcaagtcactgaatgccatggcctttgtcaggcatcatacttgaccattcagcagcatccaaccctgctggccactcctcttccttgaaacttttctcttggattaagtaacccagagtcttctggtttttctcctattctctggctagtccttctctgtctttgtagatacatttccttacctctatgtaatgttagggttattcaaggctgggccctaggtctgcttctgttcttttctctctccctaaagtgacagaatccatggtcatgacttcaatggacccctaaaaatggatgaattccaaatccatacatccatttcccacctgccattcacccctcactgtaacatggtttgtctcttttaggtcatcagtttcattagttcactaatgaaatcacgactgccaaatccaatgaacacttccatttcttgtcttccttaatctgtggcatgggacaatgtcagccaatctccttcttgaaattttcccttcctttaatcctgtcgcccagctgacaatcattcactttcaatcattattggtggctcttctacatgcctcttgggctacttgtttctaaaagctgaggaaacataaagttatttagaaagtaaaggcaaagtgatgccatgttaggaagggctggcagaatgaatgaaaatcaggcaaaagctcaaggatgttgtctaaacattttgttcttaagggaccagaatagttgatgtggtttggatatttgtccccacccaaatctcatggaaatataatccccagtgttgtaggtggggcctggtggggtgttggggttatggggcagatccttcatggcttggtgctgtcctctccatagtgagttcttacagagctggttgctgtaaagtgtggcacctcctccccgcactcactctcttgctcactctgtgatgtgggatgcctgctcctgcttcaccttccaccatgagtaaaagctccctgaggcctcctagaagctgagcgatgtcagatgctatgcttgtacagcctgcagaactgtgacccaattaaacctcttttcttataaactaacaactcttaggcatttctttatagcaatgcaagaatggcctaacatagtagtgaaccatgaattgatctttccctggtggaaaaaaccaaggtaagctagtgaaggcagaaagtaatatcattcctctcctttcaatacttccaagagatgaattcagtactgtgtctcaaaaaaaaaaaaaaagaaataaaaaataaatatttgcatcaatgaaagtttgttctatccttccctgtacttgtactatgaggacatgctttttgcttctacactacacaaagtcaacagttaccaacaacaatgcaatagaacaagatcggaacaagacttcaaagacactctactccacccaaattaagaaaattcaattcaggatgaacaacagcttttgattttagaaccagcttttacttttctctcatgtcatatgtgatgaagtcctcatttgacatttccctcctgcaaactgcaatgcatgtcctcaccatcagctttttctgacactaaaattaatttgtagaaattgcaaaaatgatgaaattgtacttccaattcggaacctctgatcagattcctgctttgacataaaacttactcctctgccgtgtaccccacgagcagagcgaccccctttctattcttttgccctgaaggcacttttggatggcttaccatgtgccctttggctgcctagacagtcaggacacctaaggccatcaggacttatcacacacctctcctcctcctttttttgttttttttttttgagattgagtctcactttgttgctcaggctggagtgcaatggcacaatctctgctcactgcaacctctgcctcctaggttcaagcaattctgctgcagcctcccaagtagctgggactacaggcacctgccccgacacccgacagatttttgtatttttagtagagactgagtttcaccatgttggccaggctggtctcgaagtcctgacctcatgcgatctgcccgcctcagcctcccaaagtgctgggattacaggtgtgcgccaccacgcctggcctcctccttcttttctacagctaatactactttcctgcttttcttctactggtgagtatctatagttggtgctgtcatcaggaaaatagtgttgatagtggctttgaactcctggatggtaagactgcatccctggacgaccctgaagtacaatgaaatatgttactgttacaacaatgctactaagcttttacatgggattttctttatcataagttatatattaatatatcctaaagcccagtcatttaagaccataaatatgagggcacagtaaatgacaacttctctacttcctctctccatctccaacgaaaagcaaccattttgtaattattattttataagcctgggtaaatttcttttacaggatctgtgtcacccaggctgaagtgcaagtagcacaattgcggctcactgcagccttgacattccagatacaggcgatcctcccatctcagctccctagcagctgggattgcaggcacactctcccacactgggctaagtttttaaatttttagtagagatggggtctccctatgttgcccaggctggtcttaaattcctgaagttaagtgatcctcttgccttggccttctaaatgctaggattacctgtatgagccatcacacctggcccatttcattcctttttttgagacggagtctcactctgttgcccaggctggattgcagtggcatgatcttggctcactgcaatctctgcctcccaggttcaagcaattctcctgcctcagcctccagagtagctgggattacaggtgcccaccaccacactcggataatttttgtatttttagtagagacgggtttttgccatgttggccaggctggtcttaaactcctgaccccatgtgatccacccaccgtggcttccgtggctttcctaagtgctgggattacaggcatgagccaccatgcctggccttttgtgagatttctaaggatgactaatcctatgtatatagctgtcagcatacactttccaagaatttaccaagtgtaatcttggctaccttgaataatgatataattggtttaataaatttttgtagtataaaggacagcccagagacagtaaagaaaaatctaggcagcctgaccccaccctgccatcaaaaacatgtaacatacaggactctttataccaacaaaaggttacaaaacctccttaacctttcctctatggaattaaagataacatctgtgaataccatagaaagttacatcttaattttataatcaaagcttcattactgtctccggactacctaacgtatgcatgctgtggagggtggtccagttccagttcctccagattttgaaggcattaaagcttcatgaatgcccaagtcatcctttttcacttccctggaactagctaccccccactgccctcaccctttcaatttttcctgcctccttcccctagcatcacttctctccaccagagcagctaactccccatggctgtaagcatcatgagaaagcaaccacgttgtgttcactaccatagtgtcagtgccaacacatactaggaggtgctcaaatattgtttagacagccaaggtctgagttgtctccatactacctttatttccaaagaaatcaaacatgtatctgaacaaaaggaggcagaaattgatcaaacacttgctttcctattgtttctaacagtttatatttatttttaaattattatttttttaaattttttgaggcacggtctcactttgtaaccaaggctggagtgcagtggtgtgatcatggctcactgtagccttgacttcccagactgaagtgatcctccagtctcagcctcctgagtagctggggctacaggtgcacaccactatgcccagctaatttttaaaaattattttagagatggggtcttgctctgttgccctggctggagtgcagaggcacaatcttgactcactgcaatctccacctcccaggctcaagcaattctcgtgcctcagcctcccgagtagctgggattacagatgcccaccaccacgcccagataattttgtatttttagtagagatggggtttcaccatgttggccagggtggtcttgaactcctgacctcaagtgatccgcccaccttggcctcccaaaatgctgtgattacaggcgtgagccactgcatccagcctattttatgtttaaattaatagacttttatttgttttatttagaaccagctcttacttttgtttacagttttgggtgagatgcctgcttctacttcaccttctgccatgagttaaagctcccttaggcttcactagaaggtgagtgatgtcagatgtcaaaaatttaatttctcaaaactcatagctatttagtaaagttaataaacacacttagcttcacacttgaatgctgttactatttattgacatcaaaacgaaacaagctgagactaaaagttgctatttaacaggaatagacactggtgcagtttccttcctggagagggtatgcactcagatcatgagacctaagatcaaacacactggattgtcaagagtcaaacaaggactacattttacctcttaatagaaaagatgctgatgacaaaacacgaagtttaaaaatattctttacgctaagctcatataagcaaacaaaaaactaaaactaatcctaaaactttaggacactggatacagaagtaacataactatttaaatttttgtatcaacgaaagtgtgttctatccttcactgtacctgtactacaaggacatgcttgttgcttctacactacccaatgtcaacacttatcatcaacaatacaatagaattagatcggaacaaggcttcaaagcgactctgctccacccaaattcagaaaattcaattcaggatgaacaacagcttttgattttagaaccagctcttacttttctctcgtgtcatatgtgatgaagtcctcacttgacaattccccctgcaaattgcaatgcatgtccttgccgtcacctttttctgacactttaaaattaatttgtagaaattgcaaaagcaatgaaattgtacttccaattctgaacctctgatcagattcctgctttgacacaagacttactcctctgcagtgtaccccaccagcacagcggctccctttctctctattctttgccctgaaggcacctctggattgcttaacgtgtgctctttggctgcctagacagtcaggacacctaaggccatctggacttatcactcctctcctccttcttttctatggctaataccactttcctgcttcctttctgctgctgaatctccagacttggtgctgtcatcagggggacagagtcgatttcggcttcgagctcctggttggtaaagctgcatcgctggacgatcctgaagtacaataaaatatgttaccattacaacaatgctactaagcttttatatgggatttttaagagtcatagttatgtatgaatatatgctcaagtgaagtcatttaagaccaaaaatgtgagggcacggtaaatgacaacttgcctacttcctctctccatctccaaagaaaagcaaccatttggtaattactattttatatgcttgggtaaatttttttttggagatagggcctcaccctgtcacccaggctgaagagcaagtgggatgatcaaggcttattgcagcctcgacattccagactcaaacgatcctcccacctcaggtacctagtaactgggattataggcacgcactaccacactgggctgtttttacattgttagtacaaacaagctctccctatgttgcccaggctgctttccaactcttgggcttaagtgatcctcctgacttggcctcccaaattgttgggattacaggcatgagccatcatgccaggccctaagtgccagttttaaaggaagcacagaagacagaggaacacgttaaataacagcatggggatgtaatctgccaattcagaacaggaaaagccctacaagacaaattggtttctgcaacaaatggtaggaaaacaagagaaggggaaattgtttagattaaaagaaaacttggctgggtgcagtggctcatacctttattcccaatactttgaggggatcggctgagctcaaaagtttgagaccagcctgagcaacatagggagacctcatctctacaaaaaaacttaaaaattagctgggcatggtgatgcatgcctgtagtcccagctactctggaggctgaggtagggggatggcttaagcccaggaggtcgaggctacagtgagctgagattgtaccacggcactccagcctgggtgacatagcaagactctgtctcaaaaaataaactaaaaacaaaagagaactgaagaagacatttcaaggaagcataatttgtggaatttgtttaggtcctattaaaaaaaagacattaggctgggcacggtggctcatgcctgtaatcccagcactttgggaggctgaggcgggaggatcacctgaggtcaggagttcgagaccagcctggccaacatggtgaaaccctgtctctactaaaaatacaaaaattagccgggcatggtggcttgaggctgtagtctcagctattcgggaggctgaggcaggagaatcacttgaacccgggaggtggaggttgtggtgagctgagatcatgccactgcactccagcctagatgacagagcgagactccatcgcaaaaaataaataattaattaattttaaaaagacattaatgaagcaattgggaacatatgaacactgaatagacaggacgttaaggaattattgttagttttttttggtgtgaaaatgctactagggtaatattaatagagtatttatctcatatactgaagtatttaaggaagaaattatgtgcagggtttgtttgaaaataatctagtaggggtagggatgaagtagaatagaaagaaggttggcta[136 bp omitted]ctcccaggttcacgccattttcctgcctcagcctcccgagtagctgggactacaggcgcccgccaccacgcctggctaattttttgtatttttagtagagatggggtttcacc[140 bp omitted]agaatacaatggcgtgatctcggctcacctcaacctccacctcccaggttcaagtgattcttctgcctc[135 bp omitted]cagcctcccaaagtgctaggattacaggtgtgagccactgcacctggcccatcatactattctctattctacttttgtgtatgtttacaatttctata[137 bp omitted]cggtgaaaccctgtctctactaaaaatacaaaaaaataagtcaggcgtggtggtgggcgcctgtagtcccagctacttgggaggctgaagcagaagaatggcgtgaacccaggaggcggagct[132 bp omitted]tttacactttctttacacttgcaggaaaagggaaaaaaaccctcataaacaagtttaatgacaagcagcaccttgtttcttattcgatctctcttgaccacttcttctttcttttcagttttttctgagctgcctattgattctgtactttcagccttctttcctttatcccgaagtgtgtctttctcttttttcatttcttcttcttttctcttaaaagtcttctctttctcatagcgctccttctgcctacggcgctcttcttcttgccgcttcagcctctctctttctcgaagtatgcgctcctgatctcgttcatattcccgttccctctccctatagtctctgccgctctcatcttcaggtctgcatgaaaaacaaatctgagacagaaccctgaaagatcttgtaatcacaaatgcaggaacactgtgattctgatttggcccctgcaatgaggttgcacttttagagcagagtgaaaaatactagtgttttaagaaggaacaaaaccccaaaaccattcacccagattaagatacaagaatattctgaaactgttcctcctcatccccctgccctgcataaaacagcttatcttaattcaggtacatgtccaggacatagcagcaaaactagcatgtataaatcaaacataacaaagagtccttgactactgacctctttggtttttcatctttaagttcgctatcagaacgcttgggcaatgtacaactttgcccactggctctttcatcactgagattctctttgtccaatttcttggctttttctcttttgtccaattctttttcatctcctttttctggcttcttgagcagctttaaagataaaatgtttatttttattttgaaggctgggacactatcttctattaaaaacccagtataccaaatatttaaaatttagactagacaaagccccctatctctgcaggtacacttaatctttcaggtgaacaactagtgcataagagtagtaatttactaaaaggatgctattaatgttaaagtgttatccacttgaacgaagtggtttaatcactttgtggcaataggatcaagactcctttggcttttattctgaggcagggtctcactactctgttgcccatgctggagtgcagtggcatgaacatggctcaccgcaaccttgacctcctgggcttaagtggtcctcctgcctcagcctcttgagtagctaggacaacagatgcacaccaccacatatggctaattttttaatttttttgtagagacaaggtctcatcatgtcacccaggctgttctcaaacttctgggctcacaccatccttctgcctcggcctcccacagtgctgagattacaggtgtgagccactgtgcccggcttcctttggctttaaatgggtcaacctttaagtgaaccaatgcatacttcaaagtatgcttctgtagcaaaccagcatgttgatataacttaatgggaaacagcccacaaattttaagtgataggcagatcgtttctgttgggactgtttttatgtagtacttggaatgacaaataccttggtcaccaaaggagagatccattgcaggaataattttgccttgagcctgagaataacatacttatgatggtacaattatcttgccattagagattaataacaagaattatttggcatttgatttaaaaatctaaaggccttatacaaccaaatagtgaagttccatctctactgagtaggaactctgtatttaatgccatatttacgcatgttcaaaaatgccattgttttttacattgctgctatgaatctctcgagaatacctccaagtgtcggataatcagagagattcttaggcaaaatagaagaatttcaagtctcagagtgaaggtatcacacaaggttcatctcagggtgaaggcatcatgtaaattactaagcaaaaggcaaagcaccacaagacataagcacaaagcattttggcacacagacagccactgcaaatggtgagtccaaaatggacactgagaaggcaccagtgtaaaatgaggataccatgtgcaggtttcattggaagtgctcttatttctccaatgaacatccttattagaaaccaaggtgttcattactctaataagaacattaatgaatgtctctagcatggctggctctaccttctgccttgctgattgttaggaatagcaagtcaagtcacttgtggcatagcagacagagagattgctggaaagaattaagatgagaaactccatcctcccccaagcccctcatcatcagtaatgagccccgtagagacttagggaacccttgctacataaactgctgagttttcaggaaataaaataaggagaccctgccaccctctctgtgagattttctttgactttatctgaagtgctaggtactagtacttccccaggaaatatgttgaaacaagggctgcccaagccatgcccttagaagggaagtggcaaggttgggatctttctgcaggttttcttcttcccaaatgcaatgcatgaatccgaatctgctgctcacagattcccagatatatgcaggaagatactacgggagtcatgtgagagggaaaggcacatattgcagggtatttatccctagtcctcccacaaggcagccagttatgagaagcatataagaagatgagaaagaactatataggcatggttgtcctctggctgtaggtcaatgaagcttctgggcacacagcagagcatcaggaagtcacctgggcttccttttaaagtagaaatttataataaaatagctcagcttttaagaagactcaagtcaacctgaaggggttttcaacaagtaacactaccaccaccaccaccaaaaggacttattagctaagacctgtgtgtgtgacatgatactagatgctctgtatcatgtacttggtccttacatttttctgattcacagcttgtaacagaaacctgtgtacctgaagacagtggaaaacaaacagatgaggtaacttcatgtatcaattatgaagaaaaagctgaaaaaaaaccataaatcatgccagccagccctaagccctcatttactatgaatttagaggacaatagtctaaaaatccaacattttcaatgacaaaaacagcacagatctgcactgaagaaataacatactactttatccttttaaatgatcttaaatttaaaaactaatactattacaggaaagatttttattggatcacttccccccaaaagagaacaaaaacaaaacaaaaaattcatttacaccaacacaagacgcatgcatatttaaagaagtagatacgtgcaatttttagcaacatgcagtcagtttcaacattcttataccttaatctttggttcatcctttaatttgtccctttctggaattctgtctatcttctttagcttttctatatctttcctttttcgtttctcttcttctttccatttcctcctctcttcttctctttgtctttttctttctatttctctcctcctcctttcttctctcttttcttctctcattctctagaaagaaacatcaacacaagccttcaaataaaataatcatcaccaaaaccctaataaatcctgaagtcatggtaggccccaactgaataatctttccttcctactttctacaaagtggcattctaccaccgttatccccactccacccagaaaacgaaagacaatgaagaccagaacctgctaatattattcttccactgctgccttactatctctccagaggctttcagaatatcaaatgagtgtctctgggacaacctaagaacattccacgtttgtagagtgaactcctggtccaacaaccagagtgaaggagcaggctagagagtgagaccaagaaggcaaatccttaaagagtaatggtggaaaaagcagctatttctcctctagaaacccaatgctcttaaaatgtttatagaatgcaaagcaaagaaattaaagtattgagagaactataaagacaaaagatttacctgcttgtttttcaggaagctcaaaagtggggttgtctttttagctacataaatgtaaacagattattaatcatacttatcaacccctagaaacgattccattttctgacattccctgccaaccacccaaggtgggaaaacatgtacaccccttatgcagaaagatcacaattgtaatatcagaaagaagttttacagcattcgatttcaacaatacgggattaaaataccttttaaaaagtaaagaaattcaaattaaaacaacaaaataatttattaaaagagtcattcccaactgatgagaattaagtacttaggacattctcttgttttactgataggagtgtaaacttgttcaactggaagaagttggggggaaggggctaaaaatatctaatccttttgaccccataattccacttctgggaatttattctaagaaagttaccagaaataggcttgtactatccatctattaataaaagtcaagttttggaagaatatttttcattttcaacattctgaataagctattggccttacagccatcttaaaacacatattcctggccgggcacagtggctcatgcctgtaatcccagcactttcagaggccaaggcaggcggatcacttgaggtcaggagttcgagatcagcctggccaacatggtgaaaccccggctctactaaaaatacaaaattggccgggcgtggtggcggacacctgtacttccagctactcgggagactgcggcagaatcgcctgaacccaggaggcggaagttgcagtgagccgagattgcgacactgcactccagcctgggcgacagagcaagactccatctctcacacacacacacacacacacacatacacacacacacacacacacacacagagagagagcgagcgagcaagcaagcaaaaaaaacaaacaaacaaacaaaaaaaccccacatattccttaggataaattcctgagtagaaatcctgggtcaaagattatgctcatgtttagagctactgatacagtagtgacagcctattactgagaaccaagatccaagctagaattcctcaagtagttttcaattttgcagtaactaatttcattttttcgtattttcaagtcaaaatttttttaggaatatgaacttattactagaaaataccaattgaccttcaaaggcttaccactgtctaaacattccttatcagtcatcgaactttttgtatttatattacatttgtgtgaaactaaataggtcaaagaatttttcccactttaatggattctcataatgctgtgaggcaggtattaccatctgcaatttacagtaacagtctcagagaaactagtaacttccctgaagtcacacagctagcaactgatggaggtaggagacttaggtactgtgatgaaaagactgttgccctgattctttttgcccacttacctattaattctctattttttgcttctatttcctctagcagtgtctctggagtagatgtcattttctcattatctgtggcataactttccaaaaactttctatattctggatctaaataatcatttgaggaaacagaaaatataatagactttaaacaaaaaaagaagacattatctacaatactgatttatcaaagaagataattttttacttcgtggaagattaaaaaaaaccaaaccatacccacaaggtagactatttagagcttaattggtcacttgctctcaggactcctatcactgatactcactataggaatctggtataacatggggtcaggaaaaatgagacgccatgcattataacagaaccactaggggtattacatagtttgcttttaaaagtcactgtcctactaaactaagttaggtgttccaaaaagataaattagagagaagtcctagatgtggcacttgaggtgatgggaattcctggagttctctcctagacctctaacatcagaaagggtgacacatctaagccattatattgcttgtttctatgtgtcacttgatcaagtcttccagatctaaatctgtaataaaaccagtatcacagctatgtgttattgagtccttaccgtgttttctttataaaatacctgtaatagtaacaaatgatggaaattaaactagatgattctaaagtaacaatctgatataaaatatggtcctagtccttatccaacataaagagttgtgtaacagctatctaacataacattacagaggtctcaaaatctggagccagtgtaccttaaatggcaattattttggtttttcagttcttgtatttctttctttctttctttttttttgagacggagttttgcttttgttgtccaggctggagtgcaatggtgcggtctcagctcactgcaacctccgcctcccgggttcaagtgattcttctgcctcagcttcccaagcagctgggattacaggtgcccgccaccatgcctagctaatttttgtgtttttagtagagatggggtgtcaccatgttggccaggctggtctcgaactcctgacctcagcaactctgcccgccttggcctcccaaagtgctgggattataggagtgagccaccgcgcctggcctcagttcttctattcctgttcaacctaatactatgtgtgtagctaattgtatatccaaagaccagaaaataggagtgacaacttcagctactttatacaaagttacctgggtatggaaattttcccatgacagttcaaaccttcttctttataaatataatggaaaccaaaagtcaaataaataatcataaaaatggtgaggcctcaagaagcacctgttaaactttgaaacctgatttttttccactattttctttttcttttttttttgagatggagtttcgctcttgttgcccaggctggagtgcaatggtgtgatctcagctcactgcaacctccgcctcctgggttcaagagattctcctgcctcagcctcccgaatagctgggattacaggcatgcaccaccatacccggctaattttatatttttagtagagacagggtttctccatgttggtcaggctggtatcaaactcctgacctcagatgatccgcccgccttggcctcccaaagtactgggattataggcgtgagccaccacgcctggcctttccactatcttctaatcaataaacctatggtgatttgttactcaatagtcaacattatattgttcaatggttgaagaatgaaatgccctagccaaagagagcagagattctgtgcaagaaactctctctagtctaacaattaagcaaagcttccatcggcaaataacatttctcacttactttattttgtatattttctaatttaaaattttggggtcgaattaactctcacaaagatattatttttaaaaaccccacagcaatagcattatataattagagctatactgtaccatcatcgatagtcccgactttggtatctcttttcttagtcttcttttttgcagctttttgaaaaggtgcaaattctactatagcgggatattcctgacctgtttagaaaaaaaataccacacttgctataacaaagaaaatgtcaaaagtggatataagggaatcaacccattgctttctatgactcttttgatggcagtcatctgaagagggtctcccaaaggcataaagcacactggcacaaccataatcaacatactacaaaaggagccacaaattcacactgataacatagtgaaacaacacggcatgaaagtaaaatattcatataaattcaacttataaaatgtgatattttaatgtgaaaaagaccctacaaactatttttcattttaaaatgttagaaatctccaaaataggcaaatctatagagacagaacgtagagtagtagctgcctggagtttggggtagaagtggtgagaagaatgaggagtgacaactaatgggtggggtttctcttaggggtgatgaacatgttctaaatttagattgtggtgataggctcataagcctatgaatatactaaaattcactgaactgtatactttaaaagggtgactatttcaggcatgtgaattatatctcaataaagctgttattttttaaaagtgtaactatttgaggtgatgtgttatgtgaggtgatgaatgtgttaacttgattgtatatatttcataatgtatatatgtatacattatgtatacatttcataatgtatatatgtatacaatatgtatacatttcataatgtatacatttcataatgtatacatatataaaattatcacgttgggctgggcaccgtggcttatgcctataatcccagcattttgggaggccgagatgagaggatcacctgaggtcagaagtttgagacctgcctggccaacatggtgaaacactgtctctactaaaaatacaaaaattagctgggcgtggtggcacgtgcctgcaatcccagctactctggaggctgaggcatgagaatcacttgaacccaggaggcagagattgcagtgagccgagatcatgccactgcactccagcctgggcgacagagtaagactccgtctcaaaaaaataaatacataaaaataaaaataaataaaaatacaaaaattagccaggcgtgatagtgcacgcctgtaatcccagctacttgggagactgaggcaggagaatcacttgaacctgggaggcggaggttgcagtaagctgagattgtgccactgcactcgagcctggtaaaaaaaaaaaaaaaaaaagaaaaagaaaaaagaaaaaacaattattacatagtaaaatttaaatatatattattttatttgtcaattatagctcaataaagctggggaaaaatctgttaacacttaaaaaaaaatacaccaggacaccaaaagcacaggcaacaaaagtaaaaatacagagggtagatctcatgttaagtgttcttaccacaataaaacaaaaatataaagtatatctcttatttaaaaaaagtaaaaaatagataaattggactacgtcaaaattagaaacttctatgcatcaaaagacacaatcaacagagtgaaaaggcaacccatggaatgggagaaatatttgcaaattatattatctgataaggggtaatatcgagaatatataaagaactcctataactcaacaacaaaaaaccaaataacccaatttaaaaaatggtcaaaagacttgaatagacatttcttcaaagataatatacaaatggctaacaagcatatggaaatatgttccacattactagtcattagggaaatgcaaatcaaaaccacaatgaggtatcatctcacgcctattaggaggactactatcaaaaagcagaaaataacaagtgttggcaaagatgtggagaaactggaacactcatgtattggtgggaatgtaaaatgatgcagctgcatggaaaacagtatggcagttccataaaacattaaaaatagaattattgggccagcctgactaacatggtaaaaccccatctctactaaaaatacaaaaattagctgggtgtggtggtgggcacctgtaatcccagctactcaggaggctgaggcaggagaattgcttgaacccaggaggtggaggttgcaatgagggaagatcgcgccattgtacttactccagcctgggcaatgagggcgaaattccatctcaaaaaaacaaaacaaaacaaaaaagaactaccggcggggcacagtggctcacacctgtaacctcagcactttgagaggccgaggtgggcgcatcacttgaggtcaggagtttgagaccagcctggccaacatggtgaaactccgtctctaccacaaacataaaaaattagcagggtgtggtggcaggtgtctgtaatcccagatacttgggaggctgaggcaggagaattgcttgcacctgggaggtggaggttgcagtgagccaagatcatgccactgcactccagcctgtgtgacagagactctgtctcaaaataaataaataataaaataaaaatagaattaccaaatgactccagaaattccatttctcggtatatatccaaaagcagtgagaacaaggactcgaatatgtgcacatctgtgttcataacaatattgttcacaatagccaagagtggaagcaactcgaataccccttgacagatgaatggatacacaaaatgtggtatatacatatactggaatattagtcttaaaaatgaggctgggggcagtggctcatgcctgtaattcctagcattttgggaggctgaggcaggcatgtcacttcaggtcaggagtttgaaactagcctggccaacacagtgaaaccccatctttaccaaaagtacaaaaaaattagccagctgtggtggtgggtacctgtaatcccagctacttgggaggctgaggctggagaattgcttgaacccaggaagcggaggttgcagtgagctgagatcgcgccactgcattccagcctgggcaacaaagtgagactccatctcaaaaaaaaaaaaaaaaaaaaaaaagatgaaaattctgacacatgctacgacatggatacaccttgaagatattatgctaaatgaaataagccagacagacactgtatgtttccacctatatgtggtacctacagtagtgaaactcatacagacacaaggtataatggtggttgccaggggctggaggaagggaaataaggagttgtttaatgggtaaagagtttcagtttttcaagatgaaaaagttcccaagattgttgcacaacagtgtgaatataccttaatgctactgaactgtacacttaaaatggttaagatggtaaattttatgttacgtgtatttttacaatttttaaaaatgcaaaaggaatgaggtaatgatatatgttatatgttacaacatggatggaccttgaaaacattgtgctaggtaaaagaagccagtcagaaaagaccacatattgtatgattacatttatatgaaatggagggaaatcatagatacataaagtagattagtggttgccaggggctggagggagagaatgggaggtaactactaatagatatgggtttctttttggagggatgaaaacattctggaattagtactgatggttgtactaccttgtgaatataccagaaaccactgaattgtacgctttaagaggatgaattttattataggtgagttatatttcaatacaaaaaccccaagtgactaatgggaaaaaaattcacaagcaccctgtcacagaatgtcaaaaacaaggtatcctatccttaaatcattggcatgtagacataagcagaaaaataaaaataaacagaattgaccagaaggcactgcaaagcagtcatggaggaaaaattatgttgggaatcccagt[137 bp omitted]catggtgaaaccccatctcctaaaattacaaaaattagctgggcgtggcggcacacacctgtaatcccagctaagtcggcaggctgaggaacgagaattgcttgaacccaggaggcggaggttgtaatgagccaagattgtgccactgtactccagcctgggcgacagagttaagactctgtctcaaaaaaaaaaagagagagagagagaagaaaaagaaaaaaaacaaaaataaaaaccaaaaaacaaaactgtgatatatttgagaaggaatagataaaccagactgaaacagagggaaattgtggaagacaggctgaagaaacagaagtgaggccagaatatggaggaccctgactaccaggctaaggagtttggactttttcccccaactgttaatttaaatcattattttcaaaaagattaatttcatggcaatataatagactgaattatacaagaatgaaaaaaatggaaaatcctgtaagtttagagacagtggttgtctaggcattaagtgatgaggacataaagtgtgactgtttaaggctaggtgaacaagatattaaaaaaaaacaataaaatccagcctgggcaacataagcagaccttgtctctaagatttaaaaacaaaacaaaacaaacaaacaaacaaaaaacacaatgaggaaaggatagtctctttaataagtggtgttgagctgggtatggtggctcgcacctgtaatcccagcactttgggaggctgaggtggggggggggaaatcacttgagcccaggagttcaagaccagcctgggcaacgtagtgagaccccatctctataaaaaatttaaagaaaattagccaggcatggtgacatacatctgtagtcccagctactcaggaggctgaggtgggaggattgcttgagtccaggaattccaggctgcagtgagctctgattgcgccacagcactccagcctgggtggagaccctatctcaaaagataaacaataaattgacaagattcataacttacatgtaagagatttttaaaaaaggaaaaaattaaacacaactcagatttccaggctaagtaactagaatctagttaaatatctactggaataaaatagttggagtggaaaaatagctggcttggggagattaataaaagttggacaaacagtggcaatccttcaatttttactggcatagtccctgacaaaaatttaatttttaccaactttgaagtaatattgaaaaaaacaaaacaaaacaagaagacacactatttacctataattgcaaaccaaaaagaaaagtggcaaatggcagcttagatattctctggctaaatgtaggtagcagataatagagtgttaaagtagaaatgtgtcttccctatagactggacctttctggatataaagtaagagatgtatcaagtttctttttttcgattttgagacagagtctcgctctgtcgccaggctggagtgcagtggcgtgatctcagctcactgcaacctctgcctcccaggttcaagcgattcttctgcctcagcctcccaagtagctgggattacaggcgtggaccgccacgcctggcta[131 bp omitted]ggccgagatgtatcaagtttcatgttttaattatatacaactttgtgagaatgttaaacagtatcccaattgggaactgttggcttaatggatttgaattaaataaatgtttgtcctcgaagcaaaataagaagtaaatatttaaaacttatcaaacaagtttaagagtcacttatcagtactgcggctgaaattctacagtcaaaacagcaggtttaagccagggcaaaaaatgtgtcacacgaggagaaaacagttgcaatttcactcagttgatcaaactaaaaaaatagtaggttaataaaaataaccaaggactgtgaaaagtcacgtctatttataagactgcaataagcttattaaatgtgtaaaactctaggaagcaacgcaatgcacgagttgtcttaaacatacaaatgacaaagaaattccctttttacttcagttaccaggactcacctttattgtcaaggaatacataaccatcaaagcgatccctgaacaaaataatgtcctcttggtttttaaagttgatgtatgctctggcatacatatgaggatacaaactgcagagaggaaagcaattatgtaaatgtactcgcaggtgtctggcccaattacaagtatgcatatattaaagacaagctcaaaaatcaaatgaaaaacagtaggataaaaagaatgaaagaaacctttttcatttacccctttccttttttttttttttttacctcgtatcattagaaaaaaactcaaaataatcatgctcaggcataggttgaagatgttcctgaagctgctccttggtcaaagtgggaggtaatcttcgaattaccaccttaagaaatgcataaggaaaataaaattagtacaaatcagttttctgtcatacctgaaagaatcacagttcctgaagaaggctgggctttaaaatatgagatcacttgtaaaaacccaggagaaaatattcttctgcagcccaatgctcagaattagtcaaacataatagtaacgcggtttaaaaaaacccttggaaatgagaaccacctggagcaaggaaaaatcgcaggttttgctctttacagcagccctgcagtttaccaggtttgtgcatcattttcgatcacccattttttaacagatctagtggcaataacttagtaagccaacgctggtctttgtgggtgccacgaaatcttgatttagcaacaagtttctcccacgtccaacacatcttaaaacaaaatccttgcccattgaacttaagaattcaaaactctaacgaatacaaaaaatctacccattgctctcaaaataggatgctctcgatctaccctcctgtaccattaatcaccctgcactctcccccaactcgcctccatgaataatattcccatccctcatgtctccttcactatttaatatttctccccaattacacctttagttcctcattctttataccgtcgctcttccctcccattatcatctcacagctctgacctaaacccttcccgtttggggagtcccctcttttcctcacccccacccaggatttggccgggaggggctctccccatttcgggtgaatggatgaaccaggatgatgcgacttccattcaggcgaagagatagaaggagaacctgagaaagaaagggggcagccccattcccagccatcctccccgcgctgcggactcgtcccgccctctcccgggccagcggccgaccgggcaccttgctcagcgcttctttcttctccttgttgcgatcctgcttatcttcccccttggagctgtcccccgaggtcccaccaccgctgcctgtggccccggcgggggttaacagggttactcgcttctccttaggcctgtgctccttctcttccttcatggctacgtcccccgctgaagcggcttggccggaacggggttaccccgggcacaaacggctcccgggaagctcccgtcaaagctccgcccccaacaaatgccccttgtgataagtcgggccccacgttccattgggtcctgccaagctctcgcgagacttgggcctttcccagtgcaaaggttttaacacctggtttttacttcccgcccgccaagttcctgcgccacccaatcccctcgcggcccagactccctcggggcccgccccttcgcgcgtcattagcaattccgccatcttgaagtgactctgtcggggactacaaatcccggcatacaaagcagctacccgcttttgttgggcgttcaggggccagagctatctcagggtccctgtttgtgagtaaatcgaatcctttcatcttcagagttttccaggtcgaaagataggttcttcacgcttagtttccatcagataaactcaatgccgtccaaattttgcctcactaggggagcgacttgtattttttatcattgaattcagaggctttagcatttattttcctacaactaaaagaaaaagcctaacatttaaaaaactttattttccttatattgattaggatttacagatacttagtaaatactacaatattagccgagttcagtggcgcacgcctgtagtcccagctgctcgggaaggttgagaagagaggatcttgagcccaggaattcgaggctgcagtgagccatgatcgcgccgctgcactccagcttgggcgacagagcgagaccctgtatataaaaaagaaggataataataaataaacacaagatactgatatttaaaggagtaatatgactaaaatatacaagatttgttttcatcaccttattttagcaaaaggatccttctccccaggtactgatgtcccacagggaggggaataaaaataaaacccaacttgatttagttgcgatcaccatcttcacttaaaaagggccaattttacattatttataataactccaaactggaaacaatccaaatgtgaatctaacagtgattatgttgagtgacagaatctagacacagagtacatgttgtacaattccatttatatgaaattttagaaaaataaaaccacagtgatagaaagcagatcagtcggccaggcgtggtggctcacgcctgtaatcccagcactttaggaggccaaggtgggtggatcacctgaggtcaggagttcgagaccagcctggctaacttggcgaaaccctgtctctactaaaaacaaaaaaaattagcagggcgtggtggcacattcctgtaatcccagcactttgagaggccgaggccggcggatcacctgagatcaggagttcgacaccagcctggccaacttggtgaaaccctgtctctactaaaatacaaaaattatctgggcatggtggcaggcgcctgtagtcccagctatttgggaggctgaggcaggagagtcacttgaacctgggaggcggaggttgcagtgagccgaggttgtgccaccgcactccaacctgggtgacagagtgagactccatctcaaaaagagagagagacacagacacccatagaggacagaaaccaaattaaagatgcaataggagcccaaggcagaaagctgcctaagggccaactcccatttttgccgacctctagaatatattcccctgactctgcacttaaattttctcactccaattgtccagcctattcttggattcctattcctgtggctaaaacggtttccctgtatttgacatctgttactcttgctttcagtacctggccgttcttatgagccttgtttatgcatctgcctctgacctactgcttagctctgcacttgcatgttggtagtgtatgcctctgttttggtgtcctcactagctttaaaccaccagctgtttgtcagttgccagaataaagtgtcccagggctcagtccttagacctcttttctatgtacactcactcctttattaatctcattcattcttttggcttttctgtctttgctgacaactctac[133 bp omitted]ctactaaaaatacaaaaaaattagccgggcgtggtggcaggcagctataatcccagctactcaggaggctgaggcaggtgattcgcttgaacccaggaggtcgaggttgcagtgagccgagattgtgccagtgcactccagtctgggcgacagagcgagactccgtctcaaaaccaaaacaaaacaaaaaaagaatttacatctccagcccatacctccctgatgatttccagagtcatgtatccaactgcctattgaacatctccacttaagacgtctaacgtgttcagccaccgaatgcatccaaaactgaacacttgatcttcccccacaccaactgtattagcctcctattcctgctgtaacattaccacaaatttagtgggtttaaataatgcaagtgtattatcttacagttctgtaggttaaaagtccaacaaggttttagctttgtcctgtgagggggcaaaaaaatatagtaataataaataaacaaacagtccaatatgggtctcactgggctaaaatcaaggtgttggcaggactgagttccttcctggaggctctaggagataatagatttccttgtctttttcagattcttgaggcggcccatattccttggcttatgaacccttcgtcttcaagcatctctctctgaccctgcccctacttctgtctattgtctatatctcttttattctctgccttgccattccaagtttttttttcagggtcacagttcactgaaggcttaaactcctgagctgaagtgatcctcctgccttagcctcccaaatagctgggactacaggtgcatgccaccatgcccagctaatttattttcatttttgtagagaaggggtctcactgtgttgcccaggctggtctccaactcctggcctctgcactttcccctttcactttgaaggactcctgtgtttacattgtgtccgcctgtaaaatccaggataatctccctattttaaggacagctgattagcaacattaatttccttttgctatataacctaacacagtcatgggttctggggattaggatgtgtacaactttgggggagatattattctacctaacacatactgtagacttcctttttgatgaaacttttaattgcagtataacagatgtacagacaagtgcactaaaagtaagcatccagcttgctgaattttcacaaagtgaacacacttatgtaaccagcatgtagatcaagaaacaaaacattgccagcactccagatgctctcttcctacttgttcccagtcattttcgccaccaagaataccactatcctttttgctttttcttttttagcagctacatccttttatgaatgacttctaatactattgagtttgtctgttttgaactttatgtaaattgaatcatacagcatgtattcttttatgttaggctcctttctctcaacatttatgactgagatttctttatttatttatttagagacggaatctcgctctgtcgcccaggctgaggtgcagtggcgccatcttggcttacatcttggctcactgcaacctccacctcccgggttcaagcgattcttctgcctcagcctcccgagtagctgggagtacaggcgtgtgccaccacgcccggctaatttttgtatttttagtagaaatggggtttcaccatattggctgttggatacagtgagatctagatctctcttcaaagaatcagtatgtcagtatgttcagttctttgtcctccattgtaaagtttaacttcctcgtagtttcagtaaacaacattttccaccagttttcatcagtagttcacatctgttcccctggttacctgctccgtcctgactcaccccggtcatccgctttgacctgagtcacccctggtccctgctctgacctaagtcacctttagttacctgttcctaaccgtccttcccaccaaactattcaccccgccactctggctcatacccctggtctctttaaagtagccaatcagaattagcttagactgtgcagtccaaccctagccaataggggagcgacacagcagtaggggctacctgtgtcaggaataagaaccccttcccctcccttgttcaggtgtgctcttgccattactccattcacgagtcgcacccttctatagaagtaaaaattgtcttgctgtgaaaattaaatttatgttcgagtgctatttctttgtggcaccgaggaacaagcattt[136 bp omitted]ccttttcactgttacataatattccattgtatgagtctgctgcaatttatcccactcttaggggctaatacaaatagtgctgctgggattttagtgcatattgtttgatgattcatgtcagatacatacctaggagtggaattgctggatcacagagtaagcatatgctcaactttagtaggtactaccatagagttttccaacagggttgtaccaatttacacttatcagcagtgtgtgagagtcctgagtgcttcatacccttcccaacatctggtattgtctcgtgggtgtgtaggggtgcctcattgtagtttcactttgcatttctctaatgattaagttaagcaccttttcatacatttttcactgtgtgcctttctatccttttggttattgcaccaggttattatattatttatgccagagcaaaagaaacaaaacaaaacagggatggtgatatggctcctttccaccaagtaagggggagaacaagaataagtgtgtgcgtgtgtgtgacagagagggagaaagagagctgtccctaaagttcctcacaccactgattctcacagtttcactgtatgctccaaggttcctcttcccacttctgatgatgagcagtatcatgtttgggaccccattttagaaaagtagaaggaggctctgcctgtaatcccaacactttgagaggctgaagtgggaggattacttgagcccaggagttcaaaatcagcctgggcaacatggcaaaacccgtctccacaaaaaattaaaaaattagccgagtgtggtggcacacacctgtggtctcagctactcaggaggctgaggcgggaggatagcttgagcccgggagttaaggctgcagtgagctgtgatcgcgccactgcactccaacctgggtgactgaacaataccttgtctcaaaacaaacaaacaaacaaacaaaaacccagaaagaaaatatctatacacaaatggaagaatcttactttaaaacatcttccctgccctccattgaacaggctacttttaataaattgtcttgcccgttttttattaattcctttcacaaataaaactccttgtggaaatcttgtggaactgcctggtgttcagctccatctagcttaaaggtggtttaatatccaattttaagatcaagttgacttttatttaaatgttatattcaatgttgtttttaattaattcttgacccagatcagctctgaaattatccaaattctaaacagataattaggaaaggagttggataatttgtacagtacaaaaaattatttcacatgagcgcctgctgatcctaatattacctatgaaagaaagggtaatattttatgaattagccaagttaaaaatatgtatgagaacgttggactccttcccagtcagtgcataaaggaggcttacatagtataattatttgaagtaccttcccacagtttaaggattataacgaaagatgttaaccagctattcctgatgtctactgatgacataaaacaggaggaggtggccgggcgcagtggcttgataatcccagcactttaggaggccgaggtgggcagatcacttgaggtcaggagttcgagaccagcctggccaacatggtgaaaccccatctctactaaaaatacaaaaattagctggaagtggtggcgagcacctgttatcccagctacttgggaggctgaggcaggagaatcacttgaacctgggaggcggaggttgtggtgagcaagattgcactactgcactccagcctgggcaacagagtgagactctgtctcaaaaaaaacaggaggagctaatgaacaatataaggaattcagtcacatgggaaacagagatgaatttctcaattaagaaaagtttttagtttaaaattggtagctgagccttggaggagtgacattagattctgagggagaatacaagttgagtatgccttatctgaaatgcttcaggccagaagtgttttggatttcagaagtgtttcgaattttggaatatttgcatatatgtaatgagataacttggggataggacccgagtctcaacatgaaattcatttatgtttcatatgccccttgtacacagagcctgaaggtaattttaattttttccttggagacactgaataaactgtgtgtcgtgtgcctgtgttttgtctgtggcctgtcccacgaggtcaggtgtggaattttccacttgtgatatcatgtcagtgctcaaaaagtttcagattttggggcatttcagattttggatgctcaaactgtaccacacatgtaaactttatttatttatttatttatttttgagatggagtctcgctctgttgcccaagctggagtgcagtggcataatctcggctcactgcagcctccacctcccaggttcaagctattctcctgcctcagcctcccaagtagctgggattacaggcgccaggcatgggactaatttttgtatttttagtagagacgggatttcaccatgttggccaggctgttctcaaactcctaagctcaagtgattctcccgcttcggcctcccaaagtgctgggattacagccatgagccaccgcacccagccgcactcatgtaaacttgtaagtaaatccagtaagctttaaaaatcctgaagttgtgtaattttctcaggggaataattttacaggtataagcgtagaaaattatcagttctatttctataatgtagacttagaaagatcctgtgtactgagagtgagatgaaatttggacaaaaggagacttatggactttcacaacaacaaaacaatcatgatcaaagcttatttttgccctgtgctgggcactttgtgtgcgttgacttggttagtcctcacaccagccctatgaattgggtactgttgttttccctattttgcaatgagtgaaattaagacacgtggtcactcaaacccaaaattacatggctagaaagtaatacagctgattcataaatctaaattacatctccaaggctggtagttaaaaaaacaaaacaaaacaaaacgaaaaccctaaatcctgtgagtttgtgtaggggctattaaaaaaaactagaaaaaattatagagttatcttaaaaatactggtaaattctcagatgtaaaagtaatgttaataaaattaataaaatgtttgttacattacaaaaatatgaagagattatttatgtcaaatg[143 bp omitted]aacaccatctctactaaaaatacaaaaattagccaggtgtggtggcacgcacctgtaatcccagctacttgggaggctgaggcaggagaattgcttaaacctaggaggcggaggttgcagtgaaccaagaccatgccattgcactccagcctgggcaacagatttga[131 bp omitted]aaacccggtctctactaaaaatacacaaaaaattagctgggcatggtggcgcacgcctgtagtcccagctactcgggaggttgaggcaggagaatcacttgaacctgggaggtggaggttgcagtaagctgagatcgcaccactgcactccagcctaggcaacagagcaagactctgtctaaaaaaaaaaatagccaggcgtggtggtacacgcctgtaatcccagctacttgggaggctgagacagaagaattgcttgaacccgggaggcataggttgcagtgagccgagatcttgccattgcacttcagcctgggtgacagagtgagacttcgtctcaaaaaaaaaaaaaaaaaaaaaaaaaaaaaaaacaaaagaaacgaattagattaaagaaagctctgatatatagagctcttaaatccctcagaatttcctggatcatagtagcatcttttgttttaatgaggtgactcttggtgggatcctggatagcctcaggatgggggctggttgccaggggaaccaatcatgtaattagagggttggaactttcaaccccacatcaccccacaaacctagacctctggggaggggagaagggctgaaggttgagttgatcaccaatggccagtgatgtaatcaatcatgcctatgtaatggagcctccatagaagtcccaaaggactgagttctgagagcttctggctagctggacatgagttaccttgagggtggttctgagagagagagcatggaagctctgggccccttctcacatgccttgccctacacagcttttctatctgactatttgtctatatgcttcgtaatatcctttataataaatgagtaaatttaagtaaagtgtttccctgaattctgtgagctactctagcaaattaatggaacctgaggagagggtagtagaaacccctgatttatagctggtgggtcagaagtatagatgacaacctactacttactattggcatttgaggtggggggcagtctcataggactgagccccaaatctctgtataggatctatgggatctgatgctatctccaggtaggcaatgttggaattgaattgatttagaggagatccagctgatgtcagctggagaattgcttggttggtgtatgtgtgtatttccccacacattttggtgaccacaggtggagtgttctgtgtttccttgagtgtgagagtaggaaaaacactttgttttgttttcctatctttaaaacatccaaaaatcaattactgtaatagaccatatcagtagaataaaaagcaaaaaccacataatcatctcaaaagatgcagaaaaaatatttgccccaaatccaactccttttcatgataacaacactcaacaaactaggaatacaggggaacttttctcaactcagaaaagagcatctacaaaaaactcgcagctaataacatacttagtggtgatagactggatgttttcctcctaagatcaggaacaagagaagaatgtctaatctcaccacctctattcaacattgtcctggaagctccatcaatggcaactgggcaagacaatgaaataaaatgtattcagattgtaaaggaagaactaaaactttattggcagatgacatagtcttggttcatgtacatagaatatcgtggtcatgtatatagaaaatcctaaggaatccactaaaaaacaacctgctaggaccaataaatgagttcagcatggttccagtatataagatcaatattggaaaacaataaattttatttctatatgctgttgatgaataatctaaaaatgaaattaagaaaattattctatttgcaatagcatcaagaacaaaatattaggaataaatttaacaaaggaagtgcaatacttattctctaaatactataaaacattgtcaaaagaagtaaaagatttagctgggtgcagtggctcatgcctgtaatcccagcactttgggaggctgag[132 bp omitted]gaggcaggagaatcacttgaatctgggaggcagaggttgcagtgagccgagatcgtaccactgtactccagcctgggcgacagagccagactccgtctcaacaaaaaaaaaaagaaaaaaaaaattagccaggcatggcgttgtgcacctgtagttctagctcctcaggaggctgaggtaggaggatcacttgagcccaagagtgtgaggcttcagtgaactataatctggccactgcactctagcctgagtgacagagtgagaccctgtctctttctctctctctatatatacatatataaaaagttaaacataaacttaaccatatgacccagcaactacactcctaagtatatacccaaaggaattgaaaacagacactcaaacaaatacatgtacacccatagtcagagctaaaaggtaaatgaacaaatatccatcaacagatgattggttaataagcaaattgtgttctatgcatacaatggaatactgtttagccatagaaaggaagtactgatacatactacaatgtggatgaaccttgaaaactaaatgaaagaagccagacatgaaagattccatattgcaattccatttatatgaaatatctaacataggctgggcgaggtggcttacgcctgtaatcccagcactttgagaggccgagacgggcagatcacgaggtcaggagtttgagactagcctggtcaacatggtgaaaccccatctctactaaaaatacaaaaattagcagggcgtggtggcgcgcacctgtaatcccagatacttgggaggctgaggcaggagaattgcttgaacctgggaggtggaggttgcagtgagctgagatcactccaccgcactccagcctgggtgacagagcaagactccgtctcgggaaaaaaaaaaaaaaaaaaagaaaagaaatatataacataattaaatccacagagaatgcagattggtggttgccagggattggggggggggttggtggaggggaggaggaaatgaggagcatttgcttaatgggtgtggggttttcttctggggtgatgaaaacaatgttttggaactatatagaggtggtagttgcacaacattgcaaatgtattaaataccactaaattgtttgctttaaactggttaattttatgttatgtaaatttcacctcagcaaataaaaaagtgtttacagaaaggttcaacagccaggcgtggtagctcacatctgtaatcccagcgctttgggaggctgagggatgaggactgcttgagcccaggagttccagagcagcctaggcaacatagggagaccactgtctctaccaaaaaaaaaaaaaaaaaaaaaaaaaaaaaaaaaaaaagccgggtatcatggcccacacctgtagttccagctacttaagaggctgaggtgggaggatcacttgaacccaggaggcggagggtgcagtgagctgagatcgcgccactgcactcctgcctaggtgacagagtgagactgcatctcaaaaaaaaaaaaaatcaatatagtgattaagtgattacctgagggtgtgatcctgagatcctgagatcctgagatcctgagggtgtgatcctgagatcctgagggtgtgatcctgagggtgtgatctggaggggatccttgaggggcttcttcagtgttttcagtcttgtagttcttgacccgggtggtggttatgcaggtgttcttctataattattggttctattacaaagttgtgttttatgcactttcctgcctcaggcctttgtactaggtgttctctgtctggaatgctcttctccccgatatctgtttcatgtaggtctctgcccaaatgtcaccttatcagaagaggcccctccctgactaccatatataaaatagcattcccctacacccctgcactcttagcccattaccttgctttattgtttttcatagcactcatcacaatctgatatatatatatatatctgtcactgtctctcatgtatgttctttttttttttttttttttttagatgggttctctgtcacccaggctggagtgcagtggcatgatcacatctcactgcaacctcaaactctcaggctgaagggatcttcctgcctaagcctcctgattagctgggactacaggcacatgccaccatcccttgctaagttttttattttttattttttgtagagatggggtctcactttgttttccaggctggtctccaactcctggcctcaagtgatcctcctgcctcagcctcctaaagtgctgggattacaagtgtgagccactgtgctcacttcatgtaagttctatgaaagcagggacttgtgtgcttttgtcatgactgtatctccagtgcttaatgcctgtcatgtaatgggtgatcaatacaaatttattaaatgaatgttcacagccaccagtctagtccagtctaccatcatctgagttggaccagtgcaccacccccataactgatctccctgtttcatgtctggctgccttcaatccattccccactcttcagaattatctttttgaaatttagatctgatcatttcattttcctttttaaacccttaaaaaaattttttttttgggacggagtctcgctctgtcacccaggctgcagtgcagtggtgcaatctcggctcactgcaacctctgtgcacccccgaccccgggttcaagcacttctcctgcctcagcctcctgagtagctggaaatacaggtgcgtgccaccacccctggctaatttttgtatctttagtagagacggggtttcaccatgttggtcaggctggtctcgaattcctgacctcgtgatccatccacctcggcctctcaaagtgctgggattacaggtgtgagccaccgcgcccagctccccccacttttttttttttttttttttgagacagagttttgctctgtctcccaggctggagtgcagtggcacaaccttggctcacttcaacctccaccttccaggttcaagggattctcctgcctcagcctcccaagtagctgggattaaaggtgcccgccaccacacccagctaattttttgtatttttactagatacgggggtttca[141 bp omitted]aagtccaaagtccttaacatgacttgcaaggtgtctgctctttggccctgactaccttgtctcttttccccagccaccttagactgccttgagtttttagctggaggcagtctctcacatcagggccttagtatatatacttgtccctctacctgagatactctttctccaactcacctctcgggtctcagtttgaggctcatttcctaggggagacataggtgccctgacctttcaaactaggtaagctcctttagggtccagctgcaacctcatctcttctggagcgcttgcttccctctacatatttagtttcttttaaattgtaagaataactatttagttcccacctatgaaatgaagttgtaccatttaattaaaggtgatgaaaatattcctgaactgtagaaaatgtaatcataagcttgtaaacatgaaaagtactttgagtacactattgatttaggtgcttttatggagttacggtcccttttaagaatctgctgaatgctacggactccagaataatgctcatttgcaagtacattgtatactttttcaaaattcacagaaaaggctgggtacggtggctcacatctgtaatcccagcactttgggaggccaaggcaggcagatcacttgaggccaggagttccagaccagcctggccaacacagtgaaaccccatccctactaaaaatacaaaaaactagctggacgtggtggtgcatgcctgtaattccagctacttgggaggctgaggcaggaggattgcttgaacctgggaggcagaggtagcagtgagccgagattgcgctactgcactccagcctgggcgacagagtgagaccctgtctcaagaccaaaaaaaagaaagaagaaaaaaagattcacagacaagtattaaaaaacgtcatgtggagagtagtgcacaaacgtcatctttctcttgccctctcaactctttaagactgatttatgctcttaattctgtcgcttctctgttctacctcctagaatttagtcatcagcagcattctttcaccttttatcatctgtgttttctcctggaccttttctctcagcttatataatagataacaattcaaagtatatctttttccataacactttattctacttttgaataactttttttatttttattttttagagatgggagtcttgctatgttgcccatgctgttctcaaactcctgagctcaagtgatcctctaatcttggcctcatgaagtcctgggattacaggcatgagccactgtgcccaaccctgaataacttttttagtataaattatcagaaatagttaaaaaaatgaacattttttctggttcttttgctactcattgccatatttttctctctttttttttttttttgagacagggtctcactcctgtcacccaggttggagtgtagtagcgcaatcatggctcactgcagccttgatcttctgggttcaagggattctcccacctcagcctcctgagtagctgggactacaggtgcacatcaccacacccagctaaaatttttgcttgttttttgtagagacgggggtctccctgttgcccaggctggtctccaactcctggcctcaagtgatcctcccatctcagcctctaaatgtgctgagattacaggcgtgagccactgcgccttgcctccgtgacacttttcatttatttccttttcgtccgaagctttgtgtaggacatgacacttttccaaatgctttcctaggccaggtatggtggcttacgcctgtaatccctgcatgttgggaagctgaggcgggaggattgcttgaagccaggagtttgagatgggcttgggcaacataggagatcctatttgaaattaaaagaaacgaaacaggcagggcacggtggcctgtaatctcagcactttaggaagcccaggcgggtggatcacatgaggtcaggagttcgagaccagctcaggaggctgaggcaggagaattgcttgaacctgggaggtggaggttacagtgagctgagattatgccactgcattccagcctgggtggcacagcgagactctgtctcaaaaacaaacaaacagtcattatttaatgtccagctccatgagggcaggggctgtgtccatcttgttcactgctaatatcccccatgccaagcacagtgcctgattt[133 bp omitted]cctgtctctactaaaaatacagaaattagctgggtgtggtggtgcacgtctgtagtcccagctactcgggaggctgaggcaggagaattgcttgaacctgggaggcggaggttgcaatgagccaagatcgcgccactgcactccagcctagacaacagagcaagactctgtctcaaaaaaaaaaaaaaagaatatctttaaatggattaatgaatgtgaataaaaaccactaacccagaatttattcttgcatctgtttcgtgggattagcccaaattctagccatatcaataaaaatttactaatcatttggcctaactggcctcccggcctcgtgttccatctcccttgtgagccatcctatagccgcaaccacagtaacactaaaacaaacaaacaaacaaaaaaacccaagtctgattgtgttctcttcccaaacctctgctatctcccccgctgcctacagaatacagtcaacgctcctcagcttggattcaaggctttggccccaatctccctttttaaacctctctaggcttatttattaagtgcttattatatgccaagcactaggctagtcactgagttcataaaccagttggagagacaggtacattgactaattttaataaggtgtgatcagcactattacagagactgtgagaacacagatagtttcaggtaatggatgataaaatattgtttttgacctctgcaggttcacgagttctgtctacaatagtaatgtccaatacagtggtcagacacatttcaagtgctcaatagccacctggggctagtgtctgtcacactggatagctgagcacagatacttttatcacccatggacgtgggggttaactatagctgcttccaagacagcaagggagccgggctcggtggctcacacctgtaatcccagcactttgggaggc[137 bp omitted]cgggaggctgaggcaggggaatcgcttgaaccggggaggcggaggttgcagtgagctgagatcgcgccactgcactctagcctgggcaagagagcgagactccgtctcaaaaacaaataaataaataaataaccaagacagcaaggaacatttcccatatgtgaagcctgtggtgctagctaccagttccccaaacacaacccctctccccaacaccttggctcgggtatattttgtagtacaggctcccaagagaaagaatgcatgaaagtactttgtaaactattaagtgatacagaaatgtgatataataaacaggctcagaggtcttgctttcatcatggctttggttacttcgagcaaattatagctcttttctcaaactactcccacccctataatttatgccaaagtgttctgaaaagaaacacaggcaaaatggttatcctagggctaaaaatcctgattatacctaccttgaagcttttaatccaggaccctacttcaccacccgcctgctctgtcactttctctacaaaggaaggacacgaagtaagacttccaaaagaacaaaacgtttattttttaaatttaagaattatgggaaacctaagtaatgggaattgcatcctcatcggggtcttctggcaagtcggaagcaccaccctctcctgtagctcgatgcttctctagtttagcaatcaattctttcgctggattgaagacgccattggtctgctggtcacagacatagcagcgcggggtggtgcggaaatgctgcagtgcacagctctcgcagaaataatgcctgcacttggtgacaactgggttttggaagctctggcgacagatgaaacacttgaatggtatttcctcatcatcgcttcccacttcatagttttcatcctcatagacaccatagcgaccctcatcaagctcacgttcgatctgccacccatgcttgtaatctgaacggtcatggaggaatttgcagctgtctccgaagccgcagaagccagtctctttgtagtccttacagatgtcgggctggtaatcccagcgcacggtggcacgtagatgctcgggcgctcggatggggcccttcctcaccatcccggaagaggcattgcccatagacgtatccttgggcttcatgtatttctgataattgttgattccccgatagatcttgtcatcctccttgcccctcagctcctcctggatcttctggctgcgctcaaagatggcttgtgcatcgcgctctttctctgtgtccagctcatagacagctgtcgctcccatatcctctggtcccacgggtttcgccgaacgggtggatttataaaccacgccgagactctcgggctcattttcctcttcctcttcgctgctcaagtcgccgtaagccgccttctgtttaccactgtcacgggtcttctgtatcattggattgtgggtcacccgcttcttttccggtcgaaccacagtgcagccttcgtcgctactgctgccgctttctccgggctctgggtcgcaggccgggcgctttctgcgtccagcagcccctttccgcccaggctttttgaaaaggaaggtgcacacctgatccaccgcctttcctggagaaagctgctctgccattttagagtcctgagctccgaaacagccgtggctgcctgggttgcacttggcccctgcacgtcactccacgttgcgcgctccgccgggagtcgaagcaaaagacactgacggaagaggactgcgagagcccgagcgcccgtctctcttgtgccctagcagattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggtaagccggcttcggcccgggggccgactccacgggctgatttccgaaaagggtggtgggcagggagaccgtcagcctgcgaaccctctctccgaggtcggccctctacttgcttccggttgcctagaagccgaggcttgcgaaacgaagcccgatagaaactacatcctgctctagtgaaaaacagcgtttctgggtgtatcagagtgggccttagggcagagtagcgacgcgggggccgggaaggtagattagaaaaggtggctcaagcctgagaatcgctcactgcaacctccgccttctgggttcaagagattctcctggttgggcgcggtggatcacgcctgtaatcccagcactttgggagaccgaggcgagcggatcacctgaggtcgggagttcgataccagcctgaccaacatggagaaaccccgtctctcctaaaaatacaaaattagctgggcgtggtggcgcatgcctgtaatcccagctactcgggaggctgaggcaggagaatcacttgaacccaggaggcggaggttgcgatgagccgagatcgcgccactgcactccagcctgggcaacaagagcgaaactccgtctcaaaaaaaaataaataaagaaagaaattttcctgcttcagcctcccgagtagccgggaccacgcctggctttttttttttttttgtagaggcggggtttcatcatgtt[132 bp omitted]cctttaggaatttactgcgagatcttgtttttttacatcaggattcattttcccctcttcctagtccttcacatcatctcaagagtacaggatataaatttatttactttttgattttgttattgttcttcacgtgtgatctacagctgttgtttcttagtgtcccaaaagacaacaactagatatttctttttttttttttttaaaaaaaaaggaaaaaaaattcatgttggttaaaatagtgtaaaaagtcacaggtaccaacttaatcctaaagtttagtggtctgattttatttaggagattctgttctttgtactactaatttgcatttttatttaaacgatgattccatttctctggaatgtcccttttaaaaattgtagtatctatcaattgggtcactcacttttataaactgcaacaataattgtctcttatttgaaggaaaaaagggttgctcattttgggtatcactggagtctgatggaaagagataggcgcatctctggagttgatcgttactatgtgtcaaaggtaagatgccactctgatgccagccttttgccagggttgaggtgggttctggtaatgccttgccaagggtcatacagtgctaatatataactagcattttcttatctactagtgaggttggcatctttttacatatttaatcttttatatttcttttttttttttagtttttcttctgtcatatatttcttattctgtggattgttgcctatatcctttgcctgttccattgtctttttctttttgagctatggttctttatatattctagactttaatttttttgtctattttatatatgacatttttcccagtctgctgtttgtcttttttactttatgatgtttttcatcaggtagttctaaattttgatattcaatgtatcatgttttgttgttctggattctaggtttttatgtctcccgtacaaaggccttttctatctaagattataaaaatactttcaaaaaataaaatagagacagtcttgctgtgttgcccaggctggccctcaaactcataggctcaagtgatcttcttgcctcagccttcggaggagctgggactgcaggtgtgccactatacctggctcataaaaatacttttaaaaaataatttctcctaatattgttagtttctttaaaaaattagttatttggttacatctacaggtcattttggagtataatgtgaaaggaggattaactttacttttttccaacaggtagctagttatcgcaattacccatttatagaagagtttagtagtcctagctactcagaaggctgaggcaggaggacagcttgagcccaggggtttgaggctccagtgaactaggatcgtaccactgcactccagcccgggcgagagaatgagagcctgtctcaaaaaaaaaaaaaaaaaaaaccaccaagcacccaatttatttttatttgtaataccactctggtaaactaaatttccatgtacacatgggcctgtttcacggatgtgcttttctatactctaggtctgcctattcctgcaacaatacttcatttaaagaattactataattttatattttgattcaattatgacattgccatttttgtaggtcaaaaacgaccaagcagtagcatttcataaggctcaacttaatagtatattttttgtttttctgtctttttttttgttttttgagacaaggtctcacgctgtcactcagtctggagtgcagtggtgcaatcttggctcactgcaacccccgcctcccgggttcaagcgattcttgtgcctcagcctcctgagtagctgggattacaggcacctgccaccatgcccagctaaatttttttttgtactttttggtagagatggagtttcaccatgttggccaggctggtttcctaactcctgacctcaagtgatccgcccacctcaacctcccaaagtgttaggattacaggcgtgagcccctactcctggccctaatagtatgtttttatattttgtaggagtagttcattctcatacttcttttaaaaatgtttactttttaatattttctccttcctcatttattcctcacaacaaacctaagtaaatagtatttccattttatagacaagggtcagagtgattaagtaatattataaggactcaacctgggtgatacacctctcagtagagaggtagttgagaatctaatccaatgaacatgataatagatatctacttatctggagccatatttctcaaagtatggtccaagaataaccatcagaatcacctagcatgtgagacagaattaggatttctaagagatggctccaaggaagatacagttttaacttctcttaaggcagttcttcctgtaatagtaaaccaaatacctggactatgttatttaatacctagaagaagtgtcatcactgatgagtctttttttttttttttttttttttttgagacggagtcttgctctgtcgcctaggccggagtgcagtggaatgatcttggctcactgcaagctccacccaccaggttcaagcaattctcctgcctcagcctcacgagtagctgggattacaggtgcgctgtaatttttgtacttttagtagagacagggttt[142 bp omitted]acttagtaagatccagtaggtattttgaatagatagtgtagtgcttgtcagagaagggttcgggagttggggtccctgaattctggctctgctaattccttatggacttaagcaggtgacttttaacctctctgagcctccatttcctcatttgtaaaaaaaatggaatgagaataatagtatctacctcatgttggctgttattttttaaaacagattttaccttcttgtcctctgactcactgaggtgctttgtaaaaggatccaggtggaggccaggcatagtggctcacacctgtaatcctagcactttgggaggccgaggcaggtggatcccctgaggtcgggagttctagaccagcttggccaacatggcgaaaccccttctctactaaaaatacaaaaatcagctgggcatggtggcacatgcctttaatcctagctacttgggaggctgaggaaggagaattgcttgaacctgggagatgcaggttgcagtgaggcaagatcgcatcactgcactccagcctgcatgacgggagtgagactccatctcaaaaaaaaaaaaaaaggatccaggtggtaaagagttgcttgactttagttctgattgggggtcggggaaggtttgtttcatataaagcaatatgctgctgtcagaaaatgaaaactagaaatcattacaggttattctttagtgattataaaatttaatccaatgtattgttgcagttagagaaatgtgggatgtggaagcactctttttaataacaatgccatttaatgacactggaaataaaagtacatggcatatctttgatgggaacagacttgtcacattctcctttttaaactgtttttcagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaatgcatttcttttttttaaatatgttacacaaaatcaagcaatctacccaatgtagtctttatcacttaaaaaaaactagaaggcaactgtgaggcttgtatagacataatgtacatccataatgtacatcaagcacctgtctctgtgcctagcagctaatacttcataaattgtagttgctactattgtaatagacactagtatattttatttaactttatttatttatttttttagacagagtcttgctctgttgcccaggctggagttcagtggctcaatctcggctcattgcaacctccgactcccaagttcaagtgattctcctgcctcagcctcctgagtagctgggattacaggcacctgccactgcacctggctaatttttatatttttaatagagacggggtt[132 bp omitted]ttcaccatgttggccaggctggtctcgaattcctgacctcaagtgatccacccaccttggcatcccaaagtgctgggattacaggtgtgagccattttgcccggctgatattagtaaattttacaaacatagtttcttcagagatgaccaggggaatacagaaaaagtattttttttctagttccttttctgagtggatcctacaatgtttaaaattccagttggttaggtttgagctgagaggggtgtaagaagataattccaggccgggcgcagtggtggtgtgagacaggagaatggtttgaaaccgggaggtggaggttgccgtgagctgagattgtgccactgcactccagcctgggtgacagtgacagagtgagactccgtctccaaaaaaaaaaaaaaaaaaaattccagttgggatatgtttaaaacggattgcaccttcaaccttcatacattctgtatagtatctaacaaatagtatatgcttaagttaatttttgttttagtatacagcaacagcaatcattcggtttattaaaatgagagtgtactgagcacttgaaatagagatgcatgttcaacattaaaggtaaccaaagatgaagatctgaaaagataaaactaaagatggtgataactccatgtgtataaagcaacaccacagatgacacttccaggtgagaatactaagttgcttttcattgcttatccagtttaacatttgatctggttaccttgaacatgcctgcactgtgtgattgccattgatctaattttatagggcggggcttatagaaggaagtggtgtttaaacttacagtggtggctggattgtgccatcccttgatcggcaatgaccttttactttttactgtataaggaaagcctggtcatgattacaaacttaatagaacctgtattatcatttaatgcttcacaggccttgtgtaattgactgttaggagaactatcgccggccgggcggtggctcacacctgtaattccagcactttgggaggcgggtggatcacctgacatcgggagttcaagacctgactgatcaacatagagaaaccccgtccctactaaaattaacaaaactagctgggtatggtggcgcatgccggtaatcccagctactctggaggctgaggcaggagaattgcttgaacccaggaggcaggggttgcagtgagctgagattgcgccaccgccactccagcctgggcaacaagagtgaaattctgtctcaaaaaaaacaaaaaacaaacaaaaaagctatccctggaaaggaaggaagagggcaagtagtacacctagggagttgtggatacagaagatgtgttgaaaacatgacttatctattactacttttattgatttttaggtctgttatttctccattttgcctgtaggcagggatcatcccctacatttttatgtccttagacgactgtcacagctacacagctgtatagtgaggggctacaaaatgacaggtagagttggttaggttcacggttaagagtccaaattcttcactgcccttttttgtagcatctgctgtgaaattgagctttatttttgtactctactgctagggggtgagccagattaaagcactttgaagatagaagatttaacggtggatttcttttattttttcttttcttttttttttttttctgcaagtgcaattagaagggttttcttaagcagctctaactgatgtggtaaagctactgatgtcagatccatctgtcaccagctcttaaggcctgttaaaatgctgcttaggaaactatcccatttgctcggttttatttactatcattaagtttttaaaaaatagatgttatattcacctagctcaaaatccaacaatatgaggtatgcagtgaaaatagttgctctaatcccctgcccaacacctgtcaattgtcacaccaccccaaagggtttcttttttttatttttttgagatggtgttttcgctcttgtcacccagactggagtgcaatggcgtgatctcagctcactgcaacctccgcctcctgggttcaagcaattttcctgcctcagcctcccaagtagctgggattacaggtgcccgccaccacactcagctagtttttgtatttttagtagataaggggtttcaccatgttggccaggctggcctcgaactcctgacctcaggtgatccacctgccttggcctcccaaagtgctgggattacagctgtgagccactgcgcctggcgtgggtttctttttactttaaaaataatcctttttggctgggcatggtggctcaaaaaaaaaatccttttttattaaacccaaaccaaaaatggtcaatagtgtttctttttctttttttctttttttcgagacagggtctcactttgtcacccaggctggagtgcagtagcaagatcttagctcactgcaaccactgcttcctgggctcaagtgatcctcccacctcagcctcctgagtagctgggaccacagcaggcacttaccaccacgcctggctaattgtattttttgtagagacagggttttgccatattgcccaggctggtttcgaactcctgggctcaagagatctgccagcctcggcctcccaaagtgttgggattacaggtatgagccaccgtacctggccaatagggtttctttttgcacatacaaatacaaacgggttcttctgtcttgtatgcaattgtagtatctgacacatactgttcacttctttggaagtttggaataatggttcttgtttgaaattacatgtaccaggttgttacttgtagggtcaaataaagtagtcaataggaaaagactgaaaaaagatagaggaagccacacatattcagaaggaagaggaagacaatggcgttgccttttgtttgggaaccaaatgatcacttagccagtggcagagctgggactagaatcctgatgttttgactcccaacctagtgtattgttctttgtggtttacttcactaaacactgattgagtaaatgctacatgccaggtgctgtacctcagatttgaatatgacaccacaggccggatgtggtagttcacccctgtaatcccaacactttgggaggctgaggcgggcagatcacttgaggccaggagttcgagaccagcctggccaacatagcgaaacccccatctctaccaaaaaataaaatgacctaaaataaatgaatgtgacacagaattgctctgcaggaactcagtcagtgggagtgacagacaactatgtgaaggataagtgctgtgacagaagtttgcagaaggtgctgtgggagcgcagaagtggggcaacccagccttgggttgaggggaaaggaaagagcttagggatacgtttccagaggatgtctacactaagctgtctggaaggctggataggatttacgagacaaacaactgaggggaggacattccaagcagagggaacagcataagggtggggacacaaatagcatggctatgtgggaaactacaagcagttctgcagagcgaagagtgtgaggcagaagagagggaccagagaggttggcagggcccagaacgtgaatgtctccccctgggtgtcggaattcctcctgagggcgactgggaagtctagcaagaggtaggagagtgatgtgacttgcgcacatctgcctggctgctctgcacagtggttctcagctgggtgagtttgcctcccagggcatattgcaacgactgcagacatttttccttgaggcaacaggaggtatgggtggggaggtgttgctgacatctagtggttagaagccagtgatgcttctaaacatcctaagatgtacaggacagtcccacattgacagtttccagtagccttaagtgtcaatagtgccaaggttgagaaactctgaaaacagtagcaggttctccattaaggaacacagtgggaagtgttttttaaaaagattctgcctgggcacagtggttcacacttgtaatcctagcactttgggtggttgagacaggagaactgcttgagcccaggagttcaagaccagcctgggcaacacagcaaaactccttatctattttgaaaaaaagtattaaagagtccgggcgcagtggttcacacctgtaatcccagcactttgggaggccagagcgggccaatcacttgaggccaggagtttgagactagcctggccaacatggtgaaacctcatctctactaaaaatacaaaaattaggccaggcgtggtggctgacacctgtaatcccagcactttgagaggccgaggcaggcgggtcacctgaggtcaggagttcgagaccagcctggccaacatggtgaaaccccatctgtaccaaaagttacaaaaattagccggacgtggtggtgtgcatctgtaatcccggctacttgggaggctgaggcaggagaatcacttgaagccgggaggtgaaggttgcagtgagccgagatcaagccactgaactccatcctgggtgacagagggcgactctgtctcaaaaacaaacaaataaataaaaatacaaaaattgctgggtgttgtggtgggcacctataatcccagctactagaaaagctgcagcacaagactcacttgaacccaggaggcagaggttgcagtgaaccgagatggcgccactgcactccagcctgggtgacagagtgagactccctctcaaaaaaaaaaaaaaaaaaaaagcgttaaagagagaaaaaagttttaaaaagtcctaattattcagaaatgtatgggagcaatttcccttctccctccctctcctggttctttttttcattcagatctctgttggctcatctgtaaacttgaagcatatcccttccctggaggcgtttgtttttccaaggaagtatcctaatgtactcttctttctttctttttttttgttttgaggcggagttttgctcttgttgctcgggctggagtgcagtggcgcaatttcagctcactgcaacctccacccccggggttcagccagttctcctgcctcagcctcccgaatagctgggattacaggcatgtgcactacacccagttaattttttgtatttttagtagagacggtgtgtcaccatgttggccaggctggtctcgaactcctgacttcaggtgatccacctgccttggcctcccaaagtgctgggattacaggcataagccaccgtgcccagcctcccaatgtactctcagtgatgtgcctcagcttgagaaggcacagaacaacatgtttcttttccaaatagatgatgtaagatgtggagacacagaaagttgggagtaacttcacatcaggaagctgcaccacctgtgggttgtgtggcctttggtaggtcacatcactgatcttagcttcagttctcccatctctcaagtgaggacagtatgtgccctgcatacgtccctgggtagctgagaagatctcacgaaatcatgtatgtgaagtagtttctaagtgtacagcctcgtgcatgtggaatggaccattgctgcattttgagcacccctttaacagctctccagccaacccccaaatccctcaggcacttacacaaaagtgatgttgggaggaccctcaggccaggtctttggtcccctgttagagtggtcacagctagggaatctcagagcactgcaaggacaacagacggtaggaactttgatgaagacactaattgtttggaagctgttttctgaaagcagagctaaaaacgcagtttcatgccactgtgagaaccgagtgcctggttacccctctcagctcttgctgcttgctctgctctaagggaaggtgctgaatggataggactgaagctggccattctcaccaagaagcttctggttgagggtaagggatggaggatgagagttaaacatcagttggttttcaagagtccatatcactctgatacttctgtgaactgagaaattattctcctgtacttctgtgggaaacaaggcacatggtacaattttagggtttttttttttttctataccaagtgtatagatttggattttagatatcaaaagagactgtcattcagcttactggtttgggtctgtgtgtgcttgtgtaatgctccctctgtcacctcatccataccctcctgaccaaatattttatctttgaggtttgaatactctagaatttttttttttttttgagatggaatctcactctgtcacccaggctggagtgcaatggcatgagtggtggagtgcttggctcactgcaacttctgcctcctgggttcaagtggttctcctgcctc[133 bp omitted]cggcctcccaaagtgctagggttacagacgtgagccaccacacatggccaattgtcacattttgatgcagttttgataaaaggcagagagaaagaaattcctataaagaataaatcctgtgttacgtttgcataatctttaattgttaagtttttttggcatatttctgtaccctatatgtcttatgctattgtctgtaatactccttcctccaaccccaaagactcttctgcaacaaaaatccaaataattgcttttaggatttccacaaatcttgattcaccattagacacataattgttctttacagggaaccactgagaaaatgacccagcagatattacttgtataaactcaagtaactgttgctttattcgtttgaacacatttggtatcatccattgttttggttcttcgtaggtgccttcctcagttcgagcaaacatggagagaccaattattatatttgggctggagagtgatcaggcaataaaacttataaacaaccatgcaattttaattatgaccccaaaaaactaatcccaaaggcaacagaaagaaggtagggaaaacactgggaacactgagcattactgccccaagaaaacaaagat[133 bp omitted]gaaaccccgtctctactaaaaatacaaaattagccgggtgtggtggtgcatgcctgtaatcccagctactcgggaggctgagacaggagaattgcttgaacctgggaggcggaggttgcggtgagctgagattgtgccattgcactccagcctgggcaacaagagtgagactccgtctcaaaaaacaaaacaaaacaccaccaccaaaaaaaccccaaccaaacaaaaaaacacagtttctttggtatactgtgcctatctgctctgtaccacctgccatgttgctggggagtgtttcattcagcagacagattttccctctaagcctaatacgcttcatttctagaggccagaagtcaccccggctaccagaagcttgttcttctctcttacctctaagaacttagtatttggggtggggttggtctggtctctagggaaactctggagttttcatacagtgcctacaagagcagcccactctagttatgaccgtggatctgaacatcaagacatcactatcaaaaatccagccattggattataaatcatgctgctataaagacacatgcacacgtatgtttattgcggcactattcacaatagcaaagacttggaaccaacccaaatgtccatcaatgatagactggattaagaaaatgtggcacatatacaccatggaatactgtgcagccataaaaaaggatgagttcatgtcctttgtagggacatggatgaagctggaaaccatcattctcagcaaactattgcaaggacagaaaaccaaacatcgcatgttctcactcataggtgggaattggacaatgagatcacttggacacagggtagggaacatcacacactggggcctctcgtggggtggggggaggggggagggatagcattaggagatatacctaatgtaaatgacaagttaatgggtgcagcacaccaacatggcacatgtacatatacgtaacaaacctgcacgttgtgcacatgtaccctagaacttaaagtatatatatatatatatttaaaaatccagccatcaggaacagctttgccatagtacttttgttctgaggaaggcactattcaatgaggcactcatgctcaaggatggccaggatattctgagaggttttcgtgacatcatgactctcaaggacctacccacctgggcctgactaccacagtactcaggtctgtggcctttactgttagaggatgggcttctgcttgggaaaggccctgggttcctaccacctcctccctctttcttcctagggcagtctggtggcctttgagacatgaagcaaagtcacttgcttagaactgaggcaggagaatagagtctggaagcagggaacctaaggccatttcatgctgacttcctagaactaaattgaaaggaaagccctacctttccacgcctacgtaacaaaagaaccagaggttgctccccttgcaaatccccacctttctgtgtggcagatgggaaattgaaagtacctctgattggttggaaaaaaagcagatggcaaattgaaagtacctctgattggtcgctttttgcaaccaatcagacgtttgcataggagtgtaactttgtaacttcacttcaacctctgattggttgctatcctaaccaatcatacggattgggggccaagtcttcgtttgtatagaagggcaactttcactctagcctctgattggctgctttccacaaccaataagatgtttgcataggagtgtgacctttgtaacttcatttcagcctctgattgtgggctgcaacttcatgaacatggggtgaacaccaagtggccaatggtaaacctctagcgggtatttggaccccagaagattgtgtatcagggcccttgagccactgctccgcccgttctcacactgtggagtatactttcactttcaataaatctgtgcatgcttgcttctttctttcctgtctttgctgtgcgttttgtccaattctttgttcaaaacgccaagaacctggacaacttgcagtaaagaccctctactggtaacagaacctgcccaaatccaacatgcctcatgttttgggtaagaaagcatttcattgtcccctgctttgacttacttgctagttattttttcatgtgaacacactttgtcttcccaactatattgtaagtgcatcgagggtgggaaccttgtcttaagccagttttacttctcacaattcctgccacctgcgcactttacagtcacttaaaagatacgtggtggccgactgggttcattcgacaagcagagaatgtcagctttaagcctaggcttgtggctaagaggcatcagccttgctagggattggtaggataagagaaagaaggggaaaaaataagtaagggtagggttgaaagggtgagcatgagagtataaggggaggagagggaagaaactgagagggaatgaaaatgaggcataggtggaaaagagtataattcaaggcccagggtgtggagtcccaagagagagctctgtcctctcttccttgtgctgtgatgtagactacccctatc[136 bp omitted]caacatggtgaaaccctgtgtctactaaaaatacaaaaattagcagggtgtggtggtgcatgcctgtaatcccagctactcaggaggctgaagcaggagaatcgcttgaatccgggagggggaggttgcagtgagccaggatcgtgccattgcactccagcctaggcgacaagagcaagactctgtctcaaaagaaaaaaaaaaaaaaaaaagcagcagcagcagctaagagagtgtaggccaggcgcgatggctcatgcctgtaatcccagcagtttgggaggctggggcgggcggatcacttgtggtcaggagttcgagaccaatctggccaacatggtgaaatcccgtctctactgaaaatacaaaaattagctgggtgcggttgcacacacctgtaatcccagctacttgggaggctgagacaagagaatcgcttgaacccgggaggcagaggttgcagtgagccgagatcgcaccactgcactccagcctgggcgacacagtgagactccgactaaaaaaaaaaaaaaagtgtgtggatctgcaagactctccaaagcagttctctctagtgagcacaacatccttgatacaaatttccccctcccctccactccccacattcaggacaagggaggcgctggccctctcgccccctggcggtctgtctagctcccggcagcctcggaaagcccaggacagtagggcagtgtacttgcgaccgaccccgcccatcggctcctggggagctgacaggacgcactccacttggccaggcctgtatcaggctctggctctgtcgcccaggctgtaatgcagtggtgcgatcatggctactgcagcctcgacctcccgggctcaagtgatcttccatctcagcctcccaagtagctgagaccacaggagcgcgccgccacgcccggctaatttttgttactggggcggcgcgtattggtgcagtctccacgttctttcagaagaacgcgggcgcatcgctggaccacgcgccagtgggcagccggcgcagcctccctgccccccatagtcccgatgcttccagaggcccatggcgggggtgcggcgcgggggtggggagtcgggtgggagttatggcttcccaagcagccaagtctattttcttcccgaagagggaggggctgagcttggcaaggctctagccagctcctcccgctctgccccacctgctcctcccagctctcccctccatctctgcttccaagccatttttctccactcatacctgcactagcatccgagcagggagtagtttggaagaacttgtcctcggcgctgcatgaggattcaaaaggcctctcaacctagagagccctggaagccaaaatttgtgcgtttcagtaaggggcttggctgggggtaagaagtaaagttctggccacagaatttaagcttctgcttcaaagaaggagcctttctaatctgctgggaaatctctccaggttccctccacgaaagtattttgcctgcatttgtctcctctgggcaggcaataaggaatcctactcccagcccgttggggtggcttacgcctgtaatcctagcactttgggaggctgaggcaggaggatcgcttgaggtcaggagtttgagaccagcctgggtaacatagtgagacctagtctctacaaaaaattagctgaccttagtggtgtgtgcttgtggtctctgctacttgggaggctgaggcgggaggatcagttgagtccaggaggtggaagctgcagtgaaccgtaatcgcaccactgcactccagcctgggtgacagagtgagaccctatctctcccctccccccaccaaaagaaaaatgtaaacaaaacaaaggggaaaaaaacaaatcctggccctgcgtggtagctcgcacctgtaatcccggcactttggaaggctgaggctggcggatcccttgaactcaggagttcaagaccagcctgggaaacatagcaaaaacccgtccccacaaaaaaatacaataattagctgggcatggtggcgggcgcctataatcccagccactcaagaggctgaggcaataagattgaaattccatctcaaaataaaattaaaataaggccgggcgtggtggctcacacctgtaatcccagcactttggaaggccg[135 bp omitted]gaggcaggagaattgcttgaacccgggaggaggaggttgcagtgagccgagatggcgccgctgcactccagcctgggtgacagagtgaaactccatctcaaacaaaacaaaacaaaacaaaaaaacgaaaaaagaaaaaagaaagaatcccactccccttcccacatcaggtcctcaccaccatgttcttctcaccagtggcctctggggtgcctaggagaggtcttgctgtccttgcccacctaagctcgacacgaaggaaacgggagctctgctttacacaatgcagctactgtggggcctgtttctaacccccatcccagaagcagcacaactcccccaccctgaacccaggaggagggcagggctgtggttcctggcctgttgtggcaccagagggttaaagacagttggtgtgatgggctttctgggaatcagaccggtgagcagaaccgagggcagtcaccatcgtcaatcacagctccggagcttatgtgctcaacaacaacaacatccacacaaatcctcttatttatttattgagatggagttttgctcttgccgccaaggctggagtgcaatggcgcgatccggctcactgcaacctttgcctcctgggttaaagcgattctcctgtctccgcctcctgagtagctgggattacaggtgcccgccaccatgcccggctaatttttgtattttcagtagagacggggt[131 bp omitted]cttccgggcactgaccctaccacatgagagctcaggacacactggtccctggagtactgggctaattctcccagctcagcagagtggtgggctcttcccggttcctctgcttttggagtctgtgctggtcattgagaggtgacagcgtgctggcagtcctcacagccctcgctcgctctccgcgcctcctctgcctgggctcccacttcggcggcacttgaggaggccttcagcccaccactgcactgtgggagcccctttctgggctggccaaggcaggagccggctccagggaggtgtggagggagaggcgccagcgggaaccggggctgcgcgcagcgcttgcgggccagctggagttccgggtgggcgtgggcttggcgggccccgcactcggagcagccggccggccctgccggccccgggcaatgaggggtttagcacccgggccagcggctgcggagagtgtactgggtcccccagcaatgccggcccaccggcgctgcgctggatttctcacttggccttagctgccttcccgcggggcagggctcacgacctgcaactcgccatgcctgagcctcccaccctctccgtgggctcctgtgcggcccgagcctctccgacgagcgccgccccctgctccacggcgctcagtccgatcaaccacccaagggctgaggagtgcgggcgcacgcgcaggactggcaggcagctccacctgcagccctggtgtgggatccactgggtgaagccagctgggctcctgtgtctggtggggaggtggagaacctttatgtctagctcagggattgtaaatacaccaatcggcgctctgtatctagctcaaggtttgtaaacacaccaatcagcaccctgtgtctagctcagggtttgtgaatgcaccaatcgacactctgtatctagctactctggtggggacttggagaacctttgtgtggacactctgtatctagctaatctggtggggacttggagaacctttatgtctagctcagggattgtaaacgcaccaatcagcgccctatcaaaacagaccactcggccctaccaattagcaggatgtgggtggggccagataagagaataaaagcaggctgcgggagctagcagcagcagcaacctgctgaggttctcttccacaatgtggaggtgttgttcttttggtctttgcaataaatcctgctaccggccactctttggatccacactgcctttatgagctgtaacactcactgtgaaggtctgtagcttcactcttgaagcttagcaggaccacgagtccaccgggaggaatgaacaactccagactagccgccttaaaagctgtaacgctaactgcgaaggtctgcagcttcactcctgagccagcgagaccacgaacccaccagatggaagaaactccgaacacatccgaacatcggaaggaacaaactccagacgtgccaccttaaaagctgtaacactcaccaagagggtccgcggcttcattcttgaagtcagaccaagaacccactaattccaggcccagtcagtcttaccatcatcatgatacgttaactaatgtttattgagcatgtacaatgtatctgtccttgttttgaggtctctgtttgaatcacctaaattcatctttttaccaaccctataaaaagcctattaagatccccattgtgcacatgagactcagagaggtaaaactatggaatgagaccactgcttctcctgttgtccttcttagcttctcccccacctcccctttgccctagtttatgagacaggagaaaagggagaaagcaaaaagttggaaagaaacagaagtaagataaatagctagacgatcctggcgccagcacctgggtggtggttaaaataataacaccagtagttttggtcaggggttatctgtgaattccagacattgtatgagaaagcactgtaaaaccttttgttctgttacctgatgtatgtagcccccagtcacgttcctcacgcttacttgatctattatgactctttcacgtagactccttagagttgtaaggccttaaaagggctaggaatttctttttcggggagctcggctcttaagacgtgagtctgccgacgctcccagacaaataaaaaacctcttccttctttaatccggtgtctgaggagttttgtctgcgactcatcctactacaaaacaacctgcctgaagtcacagttacaacgccagtatgtggcagagctcggatttgaaaccctgtactgtatctgcattcagagtctgtgttgtttcttttttttcctttgtgacagagtttcgctcttgttgcctgggctggagtacaatagcacaatcttggctcactgcaacctctgcttcccaggttcaagcgattctcctgcctcagcctcccaagtagctgcgattacaggccagcaccaccatgcctggctaatttttgtatttttagaagaaatgggttttcaccacg[136 bp omitted]aaactcctcccttcccaccctccattcccctgcctcaccactccacctccacagcatgatctctgggtgtgggacctcaaaacatgtgatgtcttccaggcagtgagctcagcatttcttcctggataaagacacttaacattgcagttttcttcctttgttgggtttgaaatccactgtcttttttttttctttgagccggagtttcgctcttttcgcccaggctggagtgcagtggcgagatctcggttcactgcaacctccacatctccggttcaggtgattctcctgcctctgcctcccaagtagctgggattacaggcgcctgccaccatgcccagctactttttagtagagacggggtttcactgtg[133 bp omitted]gatatctacgctgggcatggtgggtcatgcctgtaatcccagcactttgagaggtggaggtgggagcctaggagttcaagaccagcccaggcaacaaatagagaccttgtctcaacaaaacaaacaaacaaacaacaaactgggtgtagtggcacatgcccgtgggcccagctacccaggaggttgagttgggaggatcacttgagcctgggaggttgaggctgcagtgagccttgatcacaccattgcactccaggctgggaaacattttgagatcctgtctcaaaaaaaaaaaaaaagaaagaaagaaaaagaaaggctgggcacagtggctcacacctgtaatcccagcagtttgggaggccaaggtgggcggatcacctgaggtcaggagtttgagaccaaaaattatttgggcgtggtggcaggtgcctgtaatcccagctactcaggaggctgaggcaggagaatcgcttgaacctgggaggcggaggttgc[135 bp omitted]ttatagagagagattatgatgtaccaggcattgttcttggtcttcacatgaattgcctggtttgatccccataaaatccctattctgtaggcattgttattaaccccattttatagacaagggaactgagaaagaaaaatgttaaattgttcctgagtgtaagctgataagcactatatctctttcatctttgattcataaaagacatctttgaaagctgtaaaaggaaaataaaaacttgggaccccaattcactctgccaaaaggaaaaaaaattaaactgaaagctgagtcatgcaagaagctgcctttccttttgttcctaagcagacagctacaaataacaggttaaatatctccacctgtagctactctatgtttaccttatcttatgtaaagtgctgatttactgagcaggagacggatacataattgattcttcctctacctgctctttttctcttgcaacatgtggattcaatcatgtgaccataccttccctctcttccctcaagctcgcatttcccctttattattattatttattattattattattgttattatttgagacggagtctagctcttgttgcccaggttggagtgcagtggtgcaatcttggctcactgcaacctctacttcccgggttcaagcgattctcctgcctcagcctcccaagtagctgggattacaggtgccccccaccatgcccagctaatttttgtatttttggtagagacagggtttcaccatattggccaggctggtctccaactcctgatctcaggtgatctgcctgccttggtctcccaaagtgctgggattacaagcgtgagccactgcacctgcccttgcatttctcctttaaatactgaagcctaggccgggcgtgatggctcaggcctgtaatcccagcaccatcagaggccgaggtgcatggatcgcctaaggtcaagagttcgagaccagcctgaccaacatggtgaaatcccgtctctattaaaaatacaaacactagctgggtgtggtggcaggagcctgtaatcccagctacttgggaggctgaggcagcagaatcgcttgaacccgggaggcagaggtggcagtgagccaagatcgtgccattgcactccagcctgggcaacaagagtgaaactccatctcaaacaaacaaactaaaacctgaagcctggccaggtggggtggctcatggctgtaatcccagcactttgggaggctggggcaggaggatagcttgagctcaggagttcgagaccagcctgggcaacagagcgagaccttgtctctacaaataatttaaaaattggccaggtgtggtggtggcacacctatagtcccagctacctgggaggctgaggtgggagaatcacttgagcccaggcagtggaggctggggtgagccatgactgtgccactgcatttcagcctgggtgacagtgagaccctgtctttaaataaataaataaatactgaagccctcaaagtcatctttggagaaaggcacagacctgtctcccagacacatccttaaccttggcaaaataaactggtaaattgagacctgtttcagatactttttggtttgcaaagcaatgaagtacacatgggaagtcctaacctcagaatttggaaatgaaaaagtaaaagctcagccaaagaagtcagctttgggtgtgagtttgggacagtactttctgtacctcagtctgttcaactgcaatatgcaaatactaatacctcataatgctattgtgaggagtaaatgacttcagacactgaaggcttaacacagtgactggcatatcatagggatgcccaatacataccagctgtgaggcttatcaccactgttcttcctggcatggccctgtaagctcatcttcggctgaagagaagctaggtatagctactacagtttggtcctattattgcggtcagacagttgctgtgattggctctcccctccttccctcaccccctcccatcttaccctctgttattaacataagcagtcagaaacatgtaggctatgcttcccattggttgaaattgttgtttccttggcagcacttgcaaacattccatctggcaatctgagagaagctactgagagaatcctgagacatccccagccacctaccactgctcctgttccaagcaaagaagatctgctcactccggtactggggattctccggggtgggggagtccacagaaaggacttgcagtggttctccctattcatcacccagaccccaaacgttaccattccccccatctcttcctacccaccctgcctatctggcctctgagaaggggaggggaggagaggggaggggaggggaggggaggacaagggagagggagggggaggggaggggagcggaggggaggggagaggaggggagggaagggaagaaaaataactaggagatgccagtgggagggaggcttaagaatggtgtgggcccacagacgtgtgagggtaaaaattgagcttcttcctgggcactgctccccatcttccctctcctgttggagcacaggctccccagggaaagtcttaaggaggtccttccatgcataaagcacacaccccatgtgcttcgtgttggaggtcacagatttgacttctcatcgatttatcaataggaaatttgctgaaagcaaagttac[139 bp omitted]ggtttcaagtgattctcctgcctcagcctcccgagtagctgggacgacaggcatgcaccaccatgcctggctaatttttgtatttttagtagagacgggattttgccatgttggccaggctggtttcgaactcctgacctcaggtaatcctcccacattggccttccaaagtgctgggattacaggtgtgagccaccgcgcccggccccaaatggacaattttctttctttcttttcttctttccttctttctctctttctttcttttcttttttgaggtggagttgcactctgttgcccaggctggagtgaagtggtgagatcttggctcactgcaaactctgcctcccggattcatgccattctcctgcctc[175 bp omitted]cccggcccaaatggacaattttctaaaggatcaagttgatatatggctacctcaccaaagtctactgaaattaccaatttacccaaaaacctttgtacagttgtctttaactacagagtttatagcaggttgctctggccaaattggcatggcctaagtaagggctagggagagccagttctctagtgttaaggacctttaggctcctcactgaccaccctttagcctctggctgctctggagtgggcaacctggaaatgctctgtgtgctctggcagatgatcctgtctacctccagctgcagcaacaaggaactggggcagaggcaaactgagcttaaaaatgccaacatcagtctgggcaacatactgagacctataaaataaatagcctggtgtaggcaggacacggtggctcatgcctgtaatcccagcattttgggaggccgaggtgggcagatcacccgaggtcaggggttgaagaccagcctggccaacatggtaaaaccctgtctctattaaaaatacaaaaattagctgggcatatttttgtatttacaatacttttgtattttgtatttacacacctgtaatcccagctactcaggaggctgaggcaggagaattgcttgaacccaggaggcggacgttgcagtgagccgagattgcgccaccgcactccagcctgggtgacagagtgagactctgtatcaaaagaaaaaaataatagccagctgtggtggtataggcctttaggcccaactactcaggaggctgaggtgggaggatcacttgagcccaggaagttgaggctgcagctagctgtgattgcgccactgtactccagcccaggtaacagagcaagactctatctcaagaggaaaaaaaggaaaacaaaaagctaaaatgaacaatagccaacattatttcagggatgttcaaaggctgtcccagtggttcttgaactgatggccgttggagccaggttgccttttgcagtatctactaccccctgggatcaatgatgatgtcaagaaaggaaacagagagttgccctttgtccgggcgtggtggctcacacctgtaatcccagcactttggagattacaccaaggcaggtgtatcacctgaggtcaggagttcaagaccagcctggccaacatggtgaaaccccatctctactaaaaataacaaaaactagccgggcatggtggcggacacctgtaatcccagctacttgggaggctgaggcaggagaatcacttgaacccaggaggcagaggttgcagtgagccgagatttcgccattgcactccggcctgggcaataagagtgaaaactccgtcttgaaaaaaaaaaaaaagagttgccttttgtgaaagaggctcccagagagagagtgggtcactggactctagatgaaaatgtgagaataaggccaggcgcgatggctcacacctgtaatcccagcactttgggagac[134 bp omitted]gaggcagcagaattgcttgaacccaggaggcggaggt[131 bp omitted]gagggagaagagcagcacagttgagagcatgggctgtgaagccagacactgtgggtgtacagctcagtttcctcattttcacatggcagcaacaggccctctgtctgtgactcagggctcctgtaggaaactgttggcatattaaaatgaggatagctgtagaagggttaagtaagggaatatttacaaaggtgtggccagattgcagggcaacagaggaaggtgcagctccccggggctagtaacagtgggcctaaaacgttgaggggagagaatgcttacccttaccacactgggaagctgggagagcgccaccctgaaagacgctggggacttcatgcagccagccatcagccaactcgcagggagaaaaccaccagggacatacattttgacttcctgatctccttattgtgtggaaccccctagaagccagagggcaccatttatgggtgcagtcaggttagttttccagggcaggaagcaggaggagatgcaaggacagtggatttggaaaggcaaatggaaggtgcccagcgcactctttcatagggctgtgatgacagttaaatgaaacatagcacattaaacacccccaaattgggagctgttatttatagaaaaatagctccatttggagagagatacccactttcatgtagcccttccactcaatggaaggattgcttgcaacatacttattttttattttttgagacagccttgctctgtcaccaggctggagtgcagcgacacaatctcggctcactgcaacctctgcctcccgggttcaagcaattctcctgcctcagcctcacgagtagctgggattacaggtgctggccaccatgccagtccaactttttttttttttgagatggagtctcactctcattgcccaggctggagtgcaatggcgtgatctgggctcaccacaacctccgcctcccagattcaagcgattctcctgcctcagcctcccgagtagctgggattacaggcacgtgccaccacacctggctaatttttgtatttttagtagagacggggttttgccttgttggccaggctggtcttgaactcctgacctcaggtgatccacccgcctcggcctcccaaagagctgggattacaggcatgagccaccaaacctggcccaggccaatttttgtatttttagtagagatggggtttctccatgttggccaggctagtctcaaactcctcacctcaggtgatctaaccccttggcctcccaaattgctgggattacaggcgtgtgccaccgtgcctggccatgttttttattttctctgagacagggtctcgctctgtcacccagactggagtacagtggtgagatcacggctccctgcagcctcgacctcccaggctcaagtgatcctcctacatcagccttgtgagtagaaagctgggattacaggcacacatcaccatacctggctaattttttaaacttttgtagagatggggccttgctatgttgtccaggctgatctcaatcccctgcacttaagcgatcctcccactttggcctcccgaagtgctgggattacaggcctgagccactgcacccggctgcctgtaaggaatttaaagctgtgctggaagtaagcaatttttcataagcaaagagacttaaacagtagcaagaaaagaaaggatttaagactcaagggaaaagatgtaaaaaacattgaaaatgaggaaagacttctagctctgtgatggagccatctttacagccctagtaacacaaattttcacattgtcaatacatgttaaaggcatctggaagattatagctatcatttatgataaaaatcttactagaacaggaacagacgaatgttttcttgatgtgatacatctcaaaccacaaaccagcatcatactaatggtgtaacaccagaaagcaaggccattaaagtcagacacaataggaggatgctcattatttccactttcattttacatttttctggaagtattaaccaaagctaatactcataagagatatatactcctggaaaaaagatgataaaagtgacagtttattggagatgatataattgtatactgtactggaaaaacccaagagagagaattatgaaaccaatattcctctgctgtaatgcctctactcattttaacactatctttataggccaggtgtggtggctcacacctgtaatcccagcactttgggagtccaaagtgggtggatcacttgaggtcaggagttcaagaccagcctggccaacatggtgaacccccgtctctactaaaactacaaaaaattagccaggcatggtggcacacgcctgtagtcccagctactcgggaggctgagacaggagaatcacttgaatccgggaggcggaggttgcagtgagccaagattgtgccattgcactccagcctgggcgacag[152 bp omitted]tctactgaaaatacaaaattagccgggcgtggtggcgcatgcctccaatcccagctactcgggaggctgaagcaggagaatcacttgaacctggattctcccgggaggcggaggttgcggtgagccgagatagcgccattgctctccagcctgggcaacaagaacaaaactctgactcaaacaaacaaacaaacaaacaaaaaacaaaacactgtctttatactttttttttttttttgagatgtagtctccctctgtagcccaggctggaaggctggagtgcagtggtgcgatctcggctcacagcaacctctgcctcctgggtcccggttcaagcaattctcctgcctcagcctcctgtgtagctgggattacaggcatgagccaccatgcccagctaatttttgtatttttagtagagacgaggtttcaccatg[137 bp omitted]gagatctcactatgttgcccaggctggtttcaaactcatagcctcaaactgtccccctgcttcagcctcctgaatagctgagattacaggcacatgccaccacacccacttcattttaacatcattttaaaagagccaggtgccctcagttgctcctagcagggattgggtttcttatcaaagattcaacttggaatcaatattgctaggcactccaaagaagtgctactttttttctactacattttgatttaagtcattatggtgttttttttgttttttgttttgtttttgagatggagttttgctcttgttgcccaggctggagtgcaatggcgcgatcttggctcactgcaacctccacctcccaggttcaagcaattgtcctgcctcagcctcccaagtagctgggattacaggcgcccgccaccacacccggcaaattttgcatttttagtagagacggggtttcaccatgttggtcaggctggtcttgaactcctgacctcaggtgatccgcccgcctcgggctctcaaagggctgggattacaggcgtgagccaccgcgccgggcctcattatgattttgagaatgtgagaatccttggttttcaggaaaagtagatagcagcagccaggcacaggtctgactcctacccttaaacccctaatcccctccctagaggcaataactgcttcctgtctcttgtgattcttcaagagatgatctgtacttatatgagtgcgttcacatgtgtgtacacacacaggcacacagtaacttctttttttccccaggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaaggtagtgatcctgtttgtttggatgcctaaataattgtctatatagtctaaatatagcaccacactacctggcaactaacgaactcacaccttttttttgcagaggagcgaaaccctttgaaaaacatcaagtggatgactcacggtgaattcactgtggaaaagggtcttaaacaaattgacgaatatttttcggtaagttaggccgaccactccagcatggtacaccggtgtgaagaacaataaagagactctcagcagatcaaaagtttgaagtctggaaaatctaggagatggtatcaaagggggctgactagaataagtaaacatcatctccatctcagttccaaaatcaaggtgggatagtctttgaaggtgaaatgcacaatcacaatcattttccctgtgtctgtatcattctaaccttacatttccctgggaaaatctgctcttcctacttaagcaatttgtccatgctggtgcattaaatgggggcctagtggcctaaggagggagatgctcctccaaaataggagttctccaccaccattattttgtttattttttttagagacagggtcccactctgtcaccgaggctgcagtgcaggggctcgatcctagctccctgcagctttgaactcctgggctcaagcgatcttcccacctcagccttccaagtagacaggcacgtgtcaccacacctggctaatttttaatttttttttgtagagacagggtcgtgctatgttgctcaggttggcctcgaactcctggcctcaagggatcctcctgccttggcctcccaaagtgctgggattacaggtgtgagccattgcacccagcctccaccaccaactttagaatgctcctgttaacagaggggatgcagatggatcaaaagactttttgatttggctttggaatatattgcctgcatagtaagatgtacaatcccatgaattcctttgttcttctgcctgtgtctgactctgacttcttcgtgtggcagctttgctgagaaggccctggattactttgcataactggtgagtgaataaaggagaatggcttgggccaggcgcagtggttcacatctgtaatcccagcactttgaaataccaagacgggagaatcaatcatttgagcctaagagtttgagacagcctgggcaacatagtgggaccccatctctataaaactaaaaaattaggccaggcatagtggctcacgcctgtaagcccagcactttgggaggccgaagtgggcagatcacaaggtcaggagttcaagtccagcctggccaatatggtgaaaccccgtctctattaaaaatacaaaaattagccaggcgtggtgctgggcgcctgtaatcccagctactcgggaggctgaggcagaagaatcgcttgaacccaggaggcagaggttgcagtgagctgagattacaccactgcattctcaatcctgggcgacagagcaagactccgtctcaaaaaataataataataattagccgggcgtggtggtatgcacgtatagttccagctactcaggaggctgaggtgggaggatcacttgagcccaggaggtcgaggctgcagtaagctgtgattgtgccactgcactcagcctgggtgacagagtgagaccctgtctcaaaaaaaaaaaaggcttgaaatccttctcattgtgcttctgtggaacagagaccagttgaaattggtggaggcgaactcccctacccctgggaaaagttccagctctctctgttccccaggccagcacctcaaagcctacagccctcagggcagtttcccaggccttaggaaggcctggtcaggtgtgaaggaggaaaagtcagggatttctggctccacgccttctatgctccagcggacgccactcaccgttctcattaggaggggtatcttgagcatagtgaagatgaatggtgcaagttattcttgagccttcctgctgtggagcacttctccatttggggttgggcaaaggcccctgcctactgcactcagggttcctgaatcaaactagaatggaacacatagcaagtaggaaaaatttcccttgcaaatcccactggtcattctgagtaaaaggcaaaagtaagtcctgacaatggtctacaaggcccaatatgatctgagttccctttcccctcctgatttatggttcagctcccatcactccttcccccctctcaccttcttccctcggccacacttgcctccttgccgttcctcgactgccaggcatgttcccctgtcaggacccttgctcttgctgttccctctgcctggaaccctctcccctaagatgtatacccatggctcactgctttacctcccttcagatctttgttgaaaactatcacctgctcattgaggcttttcttggccacttcatctaaaatcacaaccctctccacttctctgattcatttttcccttcgcacttctttctgcctactagagtctatttacttgtcctactgcctgtcttccacccccagaccatatggtccatgagggcagatttctcttgactgctctcttcccagcccctagcaatgtcaggtacacagatgctcaataactctatgttgaatacatgagcagatttattattgcattaccgtatttcttcacagatgaagagccaggtcaaaggatttgtcttacctatttcgtagggctgttgtgaggacagagacaattaaaaagtaaatgactgaaaagctaaacatgttatattaactcatgatgtaaaatcgccctgttcccagccccactaatgcagcatgcctggcatttctttttttttttttttttttttttttttgagacggagtctcactctgtcgcccaggctggagtgcagtggcgtgatcttggctcactgcaccctccgcctcctaggttcaagtgattctcctatctcagcctcccgagtagctgggactacaggcgtgtgccaccgtgctggctaatattttgtatttttagtagagacagggtt[141 bp omitted]tcacccaggctggagtgcaatggtgcgatctcggcctactacaacctccacctcctgggttcaagtgattctcttgcctcagcctcccgagtagctggaattataggcacctgccaccatgccaggccaatttattttttatttttaatttttagtagagatggggtttcaccattttggccaggctggtctcgaactcctgacctcaggtgatccacccacattggactcccaaagtgttgggattacaggtgtgagccactgcacccggccaaagtgtgaggcatttctgatggagagctttttcaagcttattgccagtttcccagggtccactacacatcaggggatggtaaattaggagttgccatttactgagtactgctatgtgttaagcactgcagtgcacatcatcatgcattatctcgtttaatcctcacaacaaaactgtgtgtgggtatatcagtgtacccatttaaaagatgagaactttgcacaaattgcccaacctctctctgattgagcagcaaaacaaagttatgatcatatgtctgtctgattttttttttttttttgtgggacagggcattgctctgtcacccagggctgcagtgcagtggcaccatcttggctcactgcaacctctgcctcctgggttcaagggattctcctgcctcaggctcccgagtagatgggactacaggtgcatgctaccatgcctggctaatttttgcatttttagtagagatggggtttcaccatgttggccagtctggtctcaaactcctgacctcaagtgatctgcccacctcagcctcccaaagtgctgggattacaagcgtgagccactgtgcctggcctgatacattctttttaaaaaatatttatttatttatttatttattgagacagagtcttgctctgtcgcccaagctggagtgcagtggcgcaatctcggctcactgcagcctcaaactcctgggctcaagtgatcctcctgcctcagcctcctgagtagctaggactatgggtacacagcaccatggccgagtaaattttttatttttttgtagagatgaggtctcactttgttgctcaggctggtcttgaactcctggcctcaagtggtcctcctgcctcggcctcctaaagtgctgggattactgccagccactggcagtggccactgcacccggtgtgagccactgcacccagtcagttctatctgatatattctttccaccacagtaggaaaagtatttttttttcttatttgttttttctcatcagcttctactgacccaggaaaagtacttttggatgacaaaaataatgcagacttttattatcatttaaaaatacaaattcaaatgattttaaggtactacaat[138 bp omitted]acatggtgaaaccctgtctctacaaaaatacaaaaaaattaactgggtgtggtagtgtgtgcctgtaatcccagctgcttgggaggctgaggcaggagaatcacttgaacctgggaggcggaggttgcagtgagctgagatcgcaccactgcactccagcctgggcaacagagtgagactctgtcaaaaaaaaaaaaaaaaaagaaggatggtataggatggtatagttgtggggagggaacacttacacattgccaatggcaaagttggttcattctcttcaggaacacagtctggcaacaggaatatacaaatgggttccttataaaagaaaaatcagagaatgcccatcacctcagacagttaaaattacttttataataaaaaaaagacatcactataaaaaatgcccagtgagcaaaaagatacaaattagaaaatgaaattacccaaaatacccgtttctattaccccaaaggtcacttaaccatggataacagttttgtgcatatactttttcattgttttttgccttgtgcatatacttctatgtgtctgttgattgtgagtgtccagtagtatgtagttggctaagccatccatgatcaagtagtacagtgagatactgtttcctggaagtgagtatatgaagcagtatcatgtaaaaatcacaaaacacactcactgctgatacataaaagtctgctgcctgcacacggataaaaatgggaggagattcgcctgatgaaaatagttaaatttaatgtcatgtgtaaggctgccttcattcacaaaagggaggaaaaatccactaagagccaagctgagaagaagaaactcttagaactgaggcttctagtggggtggagaaagcactgagcgggctgctcaggagtcctgggtaccagtcccagtttattgtgttagactgtccctacctacttctaggccctggtatcctcatctgcaaagtgaagggctgcattagattatctctagtgacctattcaatgttataaagtctgtgattgtgtgacagattaaacattagggctagaaaagtatattgagtaatatagaacagttgaaaaaaaaggcatgctctggctgggtgcggtggctcatgcctgtaatcccaacactttggaaggccgaggcaggtggatcacctgtggccaggagtttgagaccagcctggccaacatggtgaaactccgtctctactatatgtgctgccgaagcgagcacagaaactccatctctactaaaaatacaaaaattagccaaatgtggtggtgcacacctgtaatgccagctactcgggaggctgaggcagaagaatcacttgaactcgggaggcggaggttgcagtgagccgagaaaacgccactgtactcaagcctgggtgacggagcaagacttcatctcaaaaacataaaaaaaaaaaaaaagaggcatgctccaatgagccataaggggttgactgttgggccccttcattaaaaggagtaatgattttggggccaggcgtggtggctcgtgcctataatcccagcactttgggaggccgaggcatgtggattacctgaggtcaggagttcaagaccagcctggatctctactaaaaatacaaaaattagctgggcgtggtggtgagcacctgtaatcccagctactcaggaggctgaggaaggagaatcgcttgaacccaggaggcggaggttgcagtgtgccgagatcacgtcactgcactccagcctggaagacagagagggactccgtctcaaaaaaaaaaaaaggaaggaataatgactttgggaggccgaggccagtggatcacttgagcctaggagtttgagaccagcctgggcaatatagggagactgtcatctctacaaaaaatataaaaattagccaggtgtggtggtgcatgcctgtatgtagtctcagctacttgggaggctgaggcgggagggtcacttaagcccgggaaggttgaggctacaatgagccatgatcgtgccactgcactccagcctaggtgacagagtaagaccctgtctcagaaaaaaggaataatgatacatgaaagaatacacagctcctgatctcaaggaatctcgagtccagtgctcttctctggactgaaacagccaattgggtacaagtttgaaataagctgaggcaaaaggccagcctacattttttttaaaggagggcctgaaatctttttgatgtctcctgtactccctctccacattactgggacttgttagactctcccaattccttccttctgtgaaccttcatcttaattcaggctcttctttgattcagaagcttctggtgccctgagagccagcccaaggaagttcagttgaattgaatttgttgaatacctgtgaaatctaaggccctgtgccaggaatcagggatgcattttgacttctgtgggccctaggcactcttccctttgtatccccctttctccttcaaaagatgaaaaaattcaagacagcactggtataaagatgaatataatcatgaccctaaaattcatatattcttcttcttttttttgaggcagagttttgcttttgttgcccaggctggtgtgcaatggcgcaatctcgtctcaccacaatctccgcctcccgggttcaaacgattctcctgcctcagcctcccaagtagctgggattacaggcatgcaccaccacgctgggctaattttgtatttttagtagagactggattact[141 bp omitted]tgtgggccctaggtattgagcttactatgccttacagataagtcagccctgttagaaatgttttaatattggccgggcatggtggctcacgcctgtaatcccaacagtttgggaggccaaggtgggcagatcacgtgaggtcaggagttcaagatcagcctgaccaacatggtgaaaccctgtctctactaaaaatacaaaaattagctgggtgtggtggtgggcgcctgtaatcccagctactcagggaagctgaggcgggagaattgtttgaacttggaaggcgaaggttgcagcgagccgagatggtgccattgcagtccagcctgggtgacagagcgagactctgtttcaaaaaaaaaaaaaagaaaagaaattttttaatatggagactacaacgcagacagttccttatggctgtactatgcggggatgtctcaagtgccataagacaggcagaaaacaagttccaccagtgttcaaagggaaagggtgtgaagtcacatctggttggaagagggatcagaaagacttcttggaggtggtagttttaaggaaaacagaatttatcaagtaggtgatagagagaagcttctcaagaaatgacaacagctggatcaaaagcatggtgtaaacatggggaatagtgctagctatagcttgatgggaatatgagcattttgttgagaaaagtgtgacatgaaacttgtttttttttttttctgagacaaggagttgcccagcctggagtgcagtggcacgatcatagctcactgcagtcttaaattcctgtgctcaaacgatcctcctgcctcagcctcccaaagtgctgggattacaccacgcctggccattgtgggaagtcttaaatgacacagtgaaacattttcattttgtttggcaggcaatgggggagctgctggaggttgctttttttttttttttctgagatggagtttcgctcttgtcgcccaggctgaagtgcaatggcgcgatctcagctcactgcaacctccgcctcctgggttcgaaggattctcatgcctcagcctctcaagtagctgggattacaggcgcccaccaccacgcccggctcatttttgcatttttagtagagacggggtttcaccatg[136 bp omitted]gaagctgtgcttaaggaaaataactctggcttcattgtgggtgggggattggagaagtgaggttgaggacaatggagtctagatgggttattgcctaagtccaggtgagaaacactaagagctgaagtagagcagtggcagtgggactggagaagaatggatagatttgagacacatttcaggtagaatagatatgatcgaaggttaataaaaaatggattaaggaaggaaggaaagaaggaaagaagaactgaatgaatgctacttttttttttttttgagatggaatttcactcttgtagcccaggctggagtgcaatggcatgatcttggctcactgcaacctcctgacttcaagtgatccgctcacctcggcctcccaaagtgctggcattacaggcgtgagccactgtgcccagcctaaatgctactttcaataatgtagttaaccttagttgtgtacagttggctctccatatctgcaggggaatacgttttcagaccctccatgcatatcaaaatccacgtgcgctcaagtcccttagtcgtccccccatccatggatgtaaccaactgtggattgaaaaggttggccctatgtattagaatccgcagtggtgggactgtattcccatctcaactccaagaataggcccagacaaaggagacattccaaggaagattttgtttctcaactctcatcactacgaagatttgtgccttgaaaggggaaagcgcctgggagtggtggctcatgcctgtaatcccagcactttggtaggctgaggcaggcggattgctcgagcccaggagttcaaggccagcctggacaacatagcaagacctggtctctaaaataaataaataaataaataaataaataaaataaaataaaataaaataaaattttaaaaagaaagggggaagcttctccaagggtgcaaacaaggaatccctcctttctgtaggatgtggattattctattgcctccctgaacttattttatataccacctatggctacaattaagtgagttggattttcacaaatggctaaagccagcctcattactttccagtcacacatttaggtctcctgggatgagcagaacaagtgttctaatcactttctaattattttccaattaattgaacctgcctcctgtgagggggtctgaagcaacatctgtgtgtatgtacatgtagacattgaagggtgtgccttgctgggcatggtggctcacacctataatcccagcactttgggaggccaaggcaggtggaacacttgagctcaggagtttgagatcagcctgggcaacatggtgaaaccccatctctaccaaaaatacaaaaattagctgggcgtggtggcgcatgcctgtaatcccagctactcgggaggctgaggcaggagaatcgcttgaacccaggaggcagaggttgcaatgagccaagatcacgccactgcactccagcctgggtgaagaagtgaggctctgtctcaatcaatcaatcaatcaatcaatcaatcaatgtgtgtccctacagtccaaggctcaatctcaactgatgtttgcattcttcacttgtttcatttcagcttaaccttttctctcctccacccatggtgataattgggagctgaccctagtttgaccccaataaaaaaatattaggagtggccaggtgcggtggctcacacctgtattcccagcactttgggaggccaaggtgggtaaatcgcttgaggtcaggaatttgaaaccagcctgaccaacatggtgaaacgccgtctctactaaaaatacaaaaagaattagccgggcttggtggcatacgcctgtaatcccagctacttgggaggctgaggcaggagaatcgcttgaatctgggaggcacaggttgcaatgagccgagatcatgccactgcactccagcctgggcaacagagagagactccatctcaaaaaaaaaaaaaaaaattaggagcggactccagaacagagctctaaccctgactgttacatgccacacttatcctttatttttatttattcgtttttttagggatagggtcttgctctgtcacccaggctggagtgtagtggtgcgatcacagctcactgcagcctcaaactcctggactcgggcaatcctattgcctcagcctccccagtagctgggattacaggtgcgtgccaccatgcctggctaatttttaaatttgttttgtagagatagggtctt[133 bp omitted]aaggcttttctttttctgtgtgctttttcttttttctatgaaacagaagtgtgtttctaaaaaatgctgggcacatggcgtagagtttgtagagaggaaagacttaattcacagcttcctctacatctactatgtacactggagtatctcaactgctgacctacccgtagcacgaatctctgctggtacctacttcaccatgaaggtctccaaaaccaaaccaccggtaagttcttctttttctcccttcagtgaggcttcagtgagaatggagacttctcttgtcaaggtcatcaataaccccatttttacaaaatttaatagtcatacttctgtcctcatcttactggcctatgcacggcacttgccaaaactgatcactccccgctccatgaaactttccatttggcttctagaacaacatactttcctgattttcctcctgcctcactgaccattccttcacagtccgtctctactggtagtttccctgcctcataccaacctcttcatgttggaatgtcctgaaactcaggccttggacctcttctctaatactcagttctgtggttatctcttccagtctcatagctttaaatgccacctagagcttatgttccccaaatttgtatctctagcacagacccgtcccacgtggatgtttaataaacatctaatttattgtatgtaaaactgaacttctgattttcccttccaagcctatctacttgcagtcttcatcttagttaatagccaaaatccttggtgtcatccttgactcttctctcatatccctcatctaatccattaggaaatcctattggctctactttcaaaaatatatccagaatccaacaaatttttttttttgagacagagtttcactcttattgcccaggctggagtgcagtggcacgatcttggctcactgcaacctccacctcctgggtttaagtgattctcctgtctcaacctcccaagtagctgggattacagtcgtgcgccaccatgcctggctggtttttgtatttttagtagagatggggtttcaccatgttggccaggctgctctcgaactcctgatctcaagtgatccacccaccttggcctcccaaagtgctgggattacaggcttgagccaccgtgcccggcccccccaaacaatttcttactactccacttctatcatcctggtccaagacaccatcttctctcaccaagattatgtcagtagcctcctaatcagtctctctgcttccacccttgccctcatcatgtctgttttcaatgttgcaggcagcctgaatgagtcttgtaaaacaaatttttctttttctttttttttttaagagatggtgtcttgctttgttacccaggctggtcttgaactcctggcctcaggctatcctcctgcctcagcctctcaaagtgctggacttacaggtgtgaaccaccacgcccagctgtaaaacaaatttgtcacttttgtgtttaaaattttccaaaagtgcttctcaaacttctctctcttttttttttaagacagagtcgctctgtcatccaggttggggcagagtggtacaatcagagctcactgaggccttgacatcccaggctcaagtgatcctcccacatcagccttccttgtagctgggactacaggtgcacaccaccatgcccagcaaactttgtgctgggattacaggcgtgagccaccacacccagctgtaaaacaaatttccgtcactcctctgttttatctatatctgtctgcctatctaatctatctatctatctatctatctatctatctatctatctatctatctatcatctatctatatctatctacttattgagacagggtctcactttgtcaccctggctggcgggcagtggcatgatcagggctcactgcagcctctacttcttgggctcaagccatcctcctgcctcagccccccaagtatgggactacaggcatgcaccaccacgcctggcttttttttttttttttttttgagttttcgtagagacaaggtcttgctatgttgcacaggctggtcttgaactcctgagctcaagtgatccacccggcttagcctcccaaagtgctgggattacaagcgtgagccaccgcgcctggcccattcttctgtttaaaactttccaagggcaggcgcggtggctcatgcttgtaatcccagcactttgggaggcttacgcgggcagatcatgaggtcaggagttcgagaccagcccgaccaacatggtgaaaccccatctctactaaaaatacaaaaattagctgggcatggtggcgcatgcctgtaatcccagctactcaggaggctgaggcagcagaattgcttgaacccaaaaggcggaggtcacagtgagccgagattgcgccactgcactctagcctgggtgacagagcgagactccgtctccaaaaaaaaaaaattaaaaaaataataaaaataaaaattaaaaaaaaatagataaacttt[132 bp omitted]tgaaaccccgtttctactaaaaatacaaaaattaggccgggcacggtggctcatgcctgtaatcccagcactttgggaggccaaggcaggcggatcacctgaggttgggagttccagaccagcctgaccaacaccctgtcactactaaaagtacaaaattagccaggcgtggtggctcatgcctataatcccagtaactcgggaggctgaggcaggagaattgcttgaacccaggaggtggaggttgcggtgagctgagatcatgccattgcactccagcctgggtaccaagagcgaaacaccatttcaaaaaaaaaagaaaaacacaaaaatatagccgggtctggtggctcatgcctgtagtcccagctacttgggaggttgaggcaggagaatggcttgaacccaggaggtggaggttgcagtgaccaagatgatgccattgtactccagcctgggtgacagagtgagattccatctcaaaaaagaaagaaagaaagaaagaaatttaaagtttgtacaaattacttagggatcttgttaaaatgaagaatctgattcagcaggtgtggggtagggattcagattctgcaagactaacaagctcgcagaccatgctgaggctgcaggcctagagaccagctttcagtagtaagggcctacaaggccctgtgtgatctggtcccttgttacttgtgctttcccactactccttccctctcactgtgctctggccattctgatcttgcttctcctcaaataagtcaggtatagtcctgcctcagggcctttgcacttgctttttcttttgactagaacactctcccctaggcatgtgaattgcctgctccctcacctcctctttcactcactttcctatgctttttctccatagcactcaccaccttttcatattctatataattgtttttgttttgttttgttttttttttagatggagtctcgttctgtcttctaggctggagtacagtggcccaatctcggctcactgcaacctctgcttcctgggtttgagtgattctcctgcctcagcctcctgggtagctgggattacaggcacatgccaccacacccagctaatttgtgtatttttagtagagatgggttatc[133 bp omitted]ccatcagaatgtaagctccataaaggctgggatttttgtcttcctgtaaaacaaggcctggcaaatagtaggcactcaataaatacttgaaagaatgattgctggtatccacgaggtagaccatgaataagaaatatgttaacttgatagctggtgtgaaaagagccaaaataacatccatgaatctaggggaagggtcgtcagaggagcagggctggtaccaagcatagtgcctgaaacataacagacataaacattttatttcctctttgccttcccatcctttcccaaaagttatttgcaccttggcctgatgttaagattttgtatatgaccacacagtcagtgagccatctatgtcctatattcatcctatcctagtacaaatgtgcctattcagagcgtttggaacctgcagtaatctaaagaggtgcaatatgcggagatcttacttctggtcatatatccctctaccagctgtcttgctaattggccaggtcagaggtcaggaaatgagactggtggaggggaacaagactacaccagagaccacacagagagaggtcttgggagaatggctcttgctcaaaattccaagtataattttggaggcgaggatgggagggactactgagacaatattacaacctacatgtttatgctgctttaaaaatgtttctcaccttttcatctatattaattcattttcatgccattcctatgaggtagagattgtcagttgagtaaagtggagcatgtaaagaaggttaatgacttacactcctattaatgaggagcacaagcctgtcccaagttatttccaatattgtaaagattcttaaggtatttgttgtcaaaaagatattttggggaacggaggtttaaagtgacaaaaaactatcacctatagattcccaattcataagcaagatgaattctagaaattcaaaagtatgcatatg[142 bp omitted]taaaactccgtctctactaaaaataaaaaaaatagctgggtgtggtggcgggcatctatgatcccagctactcaggaggctgaggcaggagaatcacttgaacccagggggtggaggttgcagtgagctgagattgcaccactgcacttacacctgggagacagagcaagaagactccatcttgaaaaaaacaaaaagagttggtatgactggtctgggctaacagttgtccttctcttttttaggatgcacccattgttgtttcttatgtaggtgaccaccaagcattagttcacaggtaatgaacatttggaggtttgttttaaaagggtgggagaaaggtcatcacactccaggaatccagcagttgcgcaacaacagatagttcatgtaatggtcacttttcttctttggaccaccaagcccattagaatgggctgaaactgttctagaaaattatttttcttagtgtctggtttttcattcattataagcttgaggattagttgctggagtggggtggaggcaaagtgggtcatgtctatcgtttctaaggaaaacttcaatatcacataaaattaactcatgtataataatcccttttatagcagctctcttaaagtatctttacatataagctcataaatcctttcattgactgggcttaagaaacagtaaaggatagacatagagaaccttagctacctcccctcccccgccaataaaagaggcttcttgcttactaggaatataaaagagtaaatagggaatcccctttgtttgattttaaaagcttttgatttaaaaatactttaaaagtgtttgtttttcttcctttgtagaccaggaatggttcgctttcgagaaaactggcagaagaatcttactgatgccaaatatagtttcatggagtcattccccttcttattcaatcgtgtctgatacttacaggatgtcttaggattgtttttctcatcaggatacattaaaaatacaatacagcacgtcaaaccacagaatatttattgagtaataaacttgtggcacacaatccagctgtatttttttgcattcattcattttccattctgcaacctccatcacattagcagagtaaccagtaagttgttttctattttctaaagtatttttttctatcactatatgtatcacttctgagtcttacaggtatagagctgagtttagagagttgctaaaattcacctattggaccaaactaaggttggtacttggctgtttgttccccatctgagcctaagtctccagctcagacacatctctttatgggcacaactgggaacaacaaaatggcaacagttctacagctcataatataaccagtctgaagggttcccctactcacagaccccttcatttactgggagttaagcctcactgctaaataatatattttgaaactggaaaactgggcatgctgccttccacaatacaccactatactcatgattgcaggagggtggcttggggactaggggcaatgacacgggaaggatacaatcattgcccttacttatctttgatcttcttcccatcctcacactgaataatcacttgttcctaccttccctgtgaacctctcttgcctggctgcaaaattttaagacaccaaagacaaaattacattatgctctgagtgattacttacaagtacatcagaatatttacttacatagaaaagcactggaaaggaggaacacaaaatatgaaagacaattgatatggtactgaaatttttcttttttaactgttagatatttgtgcaataaataaaaaaggagggaaaaccacatcagagcaataggcaaggaggtggcaaactagataagtctccttggagaacaaaaaatatatttaaaatacaatagccctactacaactgatttatggctcaggtgactaaacacaatttgaagcagtaacaacactcataagctgaaaataaaatacttttagcccttttattcttcttgcctctttcccaaagaatatgccaatgaagctgttcttgatgtcacaatattcatatatcgcagaatttctgcatttaaactaccttgcctactgaaaataagataatcatttcatctctaggaaccagtaaccaaaaaaaaaatgtccttagagaatacatttttatttgtttgtttatttagagacggagtctcattctgtctcccaggccggagtgcagtggcttgatctcggctcactgcaacctccacctcccaggttcaagcaattctcctgcctcagcctcccgagtagctgggactacaggcacgtgccaccatgcccggctacattttttgtatttttagtagagatggggtttcaccatgttagccaggatggtcttgatctcctgacctcatggtccgcccacctcggcctcccaaagtgctgggattataggtgtgagccaccacgcccagctgagaataaaatttttaagtgggtattacaaaattcaggttttattattcagggaagtagatggattgagactcaaaactttgggaactagtttcttttaacttttgaaaactacagatttattaggctaggcagcaactacaattaggtataaataaacagaaatcatttcaaattcaggggtcattaatgctgctacatgctgactcttattttcagtagttgcgggttaaaagtagacatttcctggaacatatatttaatagtatttaagactgttaatactgtttaattataaaactttgggccgggtgtggtggctcacgcctataatcctagcactttgggaggccgaggcgggcggattgtttgaggtctggagtttgagaccagcctgggcaataaggtgaaaccttgtctctactaactatacaaaaattagctgggcatggtggtgcacactggtagtcccagctgctcgggaggctgaggtggaggattgcttgagcccaggaggtggaggttgcagtgagccgagattgcaccactgaactctagcctgggtgacagagggagaccctgtctcaaaaataataataaaaaaacttttgctctatactttgaaatatgactgccttatttaaacacttttgaaaaacaaccacttaaaaatataaggcaagcgggcattttacaatagtataatcagaatgtccttatcactcaggtaatttaaatttatcataggcatgtaataataatgcagatcaaataaccttaacaaaaacggccaggcacggttgctcacacctgtaatcccagcatttcaggaggctgaggcgggcagatcacttgaggtcaggagttcgagaccagcctggccaagatggcgaaaccccatctctattgaaaatacaaaaattagccagttgtggtggtgagtgcctgtaatcccagctacttgggaggctgaggtgggaggatcacttgaacccaggaggcagaggttacagtgagccgagatcacaccactgggctccagcctgagtgacagagtgagactctatctcaaaaaacaaaaaacagaaaaccaaccttaatgaaaacagccaaaacttcctgggttccctcccccattcactcttctgacctaattaaaattgaacgaaataaacaaaggaacaagaccacgatatcatagtcccacaattttccatttctccccaacttaaaaacaaacagaaaggtttaagtgtttaaaatgaaatctacttagtatatgaaagacagttaaaaatatttaatatcattttagtttctcttatgaaacaattaagctaaaatactgactcattatatttttccttatcaaaactcttgaccatagttgactcctattcttttggatgttatcctatcctcaagctcatatcagctcagattgaaataaagtatttacatggggataagagtagacttcttaagactttatatttcaaataactatttttaagtaacttattaagaatttaggctggacgcagtggctcatgcctgtaatcccagcactttgggaggccaaggcgggcggatcacctggggttgggagttcgagaccagcctgaccaacatggagaaaccccatctctactaaaaatacaaaattagccaggcatggtggcacatgcctgtaatcccagctactcaggaggctgaggcaggagaactgcttgaacttaggaggtggaggttgtggtgagccgagatcaccccattgtactccagcctgggcaacaagagcgagattccatctcaaaaaaaacaatttaaaatatctaatgttcacattttcaattcaacaaatctgtgggttagtttgctttttggtttgtttgttggttttagagtggaggtagggacttaaatcaaaacccattatttccagggtagatcatatattatagtacacaagtcagttttcaaattccagatttgcttttcgcagcaatgccttcattttgttaacaaaagtggcctcctatatgttcctatcaagtccatttataacacattcaacacagaggagtgataatttcccaaaagttcagctggggtagaggtcggggtggggcaggcatcacatagagctaatagtagcactgtctcatggtgtgagattgaagtttctcatctcactaacactttttgttcaagccacctcctccaatacagtagcattttattcataatttggattttttttttttgagacagagtttcactcttcttgcccaggctggagtgcaatgtcacaatctcggctcactgcaacctccgcctcctggattcaagcaattctcctgcctcagcctcccgagtagttgggattacaggcgcccaccaccacgcccggctaatttttgtattttttggtagagacagggtttcacca[139 bp omitted]gctggagtgcagtggcacaatctcggctcactgcaacctccacctcctaggttcaagcaattctcctgcctcttcctctcgagtagctgggactacaggtgtgcgccaccactcctggctgattttgtattttcagtagggacagggtttcaccatg[133 bp omitted]tcaatccaaaataacccaaagaacttgctaaagttatatcaataagcagctttttattgaaggactgaaagaattaaatagaaggcacagtagcactgtaaagctttctcagaacataataatctttttctatgtatgtgtggaacccagactttcttttttgttgttaaaaatgtcttctggacaatcagaaaatctttatttgtcatccttccctttggtctttctgtaaaccatttctcgaaaactggccagaatcttgttctctctctttcgtctctcttcttggttaaaggatgcaagggctctcttctcatcagcactgtagatctggttctcttttcgcagtcgcacagcctccattcggcgatgcctggagagaattttatttttggcttaatttctcagtaattattttcatagtacatcatcattaatcctttcttacccagagtggtctatttaacagctgacaaaaattgaaatgggttaaatttccaaaagatcatttattaatattttagctgcctgacacgtcctttttttttgttttgttttgagatggagtcttgctctgttgcctaggttggaatgcagtggcacgatctcggctcactgcaacttccacctccctggctcaagcaattcccccatctcagcctcctgagtagctgagataacaggtctggctaatttttgcatttttagtagagatggggtttcaccatgttggctaggctgatctcgaactcctgacctcaagtaatccgcctgtctcagcctcccaaagtgctgagattacaggcgtgagccaccgtgcccggccctgatatgtctttgattcatttccactattcaaataatgatctctgatttcctgtcaacatagtaaatgttatccttttttcttttttttttttttttaattttttttttttttttttttgagacggagtctcgctctgtcgcccaggccggactgcggactgcagtggcgcaatctcggctcactgcaagctccgcttcccgggttcacgccattctcctgcctc[224 bp omitted]gctctgtcaccaaggctggagtgcagtggcacaatcttggctcactgcgacctctgcctcctgggctcaagtgattcccctgcctcagcctcccgagtagccgggagtacaggtgtgtgccaccacgcccgactaatttttgtatttttagtagagatggggtttcgccatgttggccatgctggtttcgaactcctgacctcaggtgatccacctgccttggcctcccaaagtgctgggattacaggtgtgagccaccatgcctggccgctatcattaatttcaaatactaagggtatacgtctaatttgtttccagtaaaacaatcagaaatgggcaaattattaaacttcctaggtgacatatccatttgcctttgtggaattggaagtaggatagataaaacatttaactagtcattaatcagatggaacttccttcaaggttctactttaccataaaaccaaaagaaccaagtctaggctgggcatggtggctcacgcctgtaatctcagcacttttggaggctgaggcaggcaggtcacctgaggtcaggagtttaagaccagcctggccaacgtggtgaaacctcgtctctgctaaaaatacaaaaattagctgggtgtggtggtgggcacccgtaatcccagctacttgggaggctgaggcaggagaatcatttgaacccaggaggtggaggttgcagtgagctgagattgcgccactgtactccagcctgggagacaagagtgaaactaggtctcaaaaaaaaaaaaaaaaaaaaaagaaccaagtctaaatctgtaattgaacagcagtttttatcagtggatttaacttccaagtctccctctgtcacccaggctggagtgcagtggcataatctcggcttattgcaacctccgcctcccaggttcaaccgattctcctgcctcagcctcctatttcatgtactgaatagttctttctttccccattgatctgacatgctatctctttcatacactgaagttccatacgtgtatggttatctttgggctctgaattttattttatttttttttgagatagtgttttgctcttgttgcccagactagagtacaatggcgaggtctcagctcactacaacctccacctcatgggttcaagcgattctcctgcctcagcctcccaagtagctgggactacaggcactagccaccacgcccagctaatttttgtatttttggtagagatggggtttcaccatgttggccaggctggtcttgaactcctgacctcaggtgatccacccgcctcagcctcccaaagtgctgggattacaggcatgagccaccacgcccggcctgaattttattccactgaacaattcagttgttctcctatgctttctaaagtgctgtaagcttcataataagtcctcctatttgtaggggaaatcttaccttcctgctcttctttttcaggagtgacttggctattcttgtccttttagtctagtatataaattttagaactggcttattaagtttcatgaaaaactgtgttctgattttgattgggactgtattgaatataaagatcaatttgggaagaaatgacaactttacaatattgccttcctatccgtgaacctggtatctctccagctatttaagttttctttaatcttaccttcttgctcttcttcttcagaagtgacctggctattcttgtccttttagtgtaatatataaattttagaaccagcttaataagtctcataaacaactgtgttgtgattttgattggaactatattgaagatatggactcttaatgtcttacatttttccccatagaaccttgggcatcttttgttaagatttattcttaagtctctcatattctgacactgttataaacgttcaaggttctaggtttctgttgttagtaaatagaaatgcagttcatttttattggaactgtattgaatacacaatctcttaataatgttttatagttttcctcacagagccctgggcatcttttgttaagatttattctgaagtccttcatattctctgatactattacaaatgttttcttcttatttagttacattttctagttgtctgttgctggtaaatagaaatgcaatggatttttgtgtactaaccttatatccaaccagttgttaaaccctcctctcatttataatttatctggagattctttgggattttctatgtaaacaatcaaatcattcaccatgtcattcacaaaaaaatgacattttttttttaagacggagtttcactcttgtcacccaggctggagtgcaatggcacgatcttggctcactgtaacctcctcctggattcaggtgattctcctgcctcagcctcctgaggagctgggactacaggtgtccgccaccatgcccagctaatttttgtatttttggtaaagacagggtttcaccatg[137 bp omitted]attattattactgttttttcaggctgagttttgctctccaggctggcatgcagtggtgtgatcttggctcattgcaacctccgcctcctgggttcatgcgattctcctgcttcagcctcctgagtagctgggattacaggtgtgtaccaccacgtctggctaatttttgtgtttttagtagagaagggtttcgccatgttgcccaggctagtcttgaactcctggactcaagtgatctgcctgccttggcctcccaaagtgctgggattacaggcatgagccaccgtgcccagccttcctttccaatccttgtgtctctaatttctttttcttgccttactgtgtgggtcctccaatgcaatgcttcaaatattggtcctcagtattacaagattctggaggtgcttcagggtttctgcaaatatttgccttcagtgtcatttaaaaatagttatctacttaaaaaaaaagtttatcaagttttaaagaatccaaaattcaatttgatctaagtactgctgccctatttgctcattctcctggttcttcctggaacttttctctttcctaattttatattcatttcccatgctgaatccagtgtctttttaaaatttatttatttattcatttatttattagccaggatatattctcagctgaccaatgtcttttatcatctttttctgttattcagtctcagaaatctgggtccataaaaaactgaagacaaacttgtaaccaggaaacactgtcttgtgaaaatattttcctaactgccacattcctcatggggcagtgataaatagctgaatttaactatatcctccagtggataaaatatctgtaagcaaataccaactaggaaaggacattaggaagattgattctttgaagtcagagatatagctgagtttgaggctgagttgcatatatacttggaattgcagaaaaccatgttatactaacaacactaatatcaaaccaatatttatactctacttttcataagaaacagtcacttaatgaaaatcaattaccaaaatataattctggtagtaaaaaagaagaaaaagatctaatcatggaaactgagcttaatgccaacaacatacctgctaccactcattacataacctgagcattcaaatgatgcaatttcttcacttgtcaagccaatttcacctcttcgtgggatacgttttccagcttttacatattcagccatagctgcaccttcaccaggtaacagagcatggccatagctacaaagtaattcagaattcagaaaaggtccattaaatcatcttaatattaaaagcttataatctaaagagagcaccaaaaatccccacattttctctcaaacaagagtaggaataacagtgctcagcagtagtgtgctaggaagctcaatgtgaattgctttatcctaattagtgtattaaacattgcattgcactatgacctatacaactaacccagaaatgcagaaatattttgaaagaaaagaactgctgtgagtatagattcacagtttacaattatggattaatttatccctacaggtattgtcattactggttctggctccagctgattccctttccctttttcccttaaaaaatccaaagtatgccaggcacagtggctcacgcctacaatctgaacactttgggaggctgaggcgggaggatcacctgagatcaggagcttgagagcagcctggccaacatagcgaaaccccgtctctactaaaaatacaaaattagccgggcatggtggtgcatgcttgtagtcccagctactcaggaggctgaggcaggagaatcacttgaacctgggaggcagaggttgcagtgagccgagatcgtgtcactgcactccagcctgggcgacagagtaaggctttgtctcaaaaaacaaaacaaaacaaaacaaaaaaaaaaaacaaagtaggctgggtgcagtggctgacgcctgtaatctcagcatttttggaggttgaggcgggcagatcacttgagatcaggagttcgagaccatactggccaacatggcgaaaccccagctctactaaaaatacaaaaattagtccgggcgtggcggcaggcgcctgtaatcctggctacttgggaggctgaggcaggagaatcacttgaatctgggaggtggaggttgcagtgagccaagatcatgccactgcactccagcctgggcaacagagtgaaactcaatcacaccactgtgcttcagcctgggagacagagtga[145 bp omitted]tggtaaaaccgtatctctactgaaaatacaaaaaaaaattagctgagtgtggtggcgcgtgcctgtaatcccagttactcaggaggctgaggcaggagaatcgcttgaacctgggaggcagaggttgcagtgagccaagatcacgccactaaactccagcctgggcaacagagcgagactccgtctcacaaaaagaaaaaaaaattctgctggtaaaaaaagaaaaaagagaaaaaaaggaataaaaaattctgtgaggatcaaagagaaacagaaatcacacctacttgtggaggggaagtattgggaatcagcatatgcatctccttttgaaaagggcttcgaaggatagtaaggattttaacaggaagaaactggcgatagggaagaaaacagagggcagggaaaagaagggaaggcatactggatgaagaaataagctgaacatggcataaaagttgcaaagtgcacattaagcccagggaatatttagtagtccagctcagctggaacctggagtagaaataagggaatagagtcagataagcttggcaaggtaagttagaaccagactttttggtaggtactttagatattataaacacactgctgcttacttcaaaggtttatcatcttgagaggtaagtgtttttggagcctctgggccaattaaatctgatggttcttcagcctctgcatgaaagatattaagaaacacattcacattctgactaattggttactttaatgtttcatctgttctgagttagtctatcagaagaacctacttgttcgatccttccagggattttccagaaactcttcttgggattctttagagcttgaatcactggactcttttctgctcttcttagacctctttttcttatatttcttcctatagggattttaatttgatacaaattcacttaatcttcctatgttagagggcatcttaatttttcttttctttttaaattttgaactggtgactatacatcttaatttttcaaggcaaagaaaggtgacaataaaatgatctgaattcccagcttattcaaacttacaagataattttacttaaaaaaatctgcttctaactgaacctgggaaacagagcaagaccccgtctctattaaaaaaaaaaaaaagtagctgggtgtgatggcacacatctgtagtctaagctattcaggaggctgaggcgggaggatcacttgagcccaggagttcgaggctgcaatgagctatgattagcccactgcactccagtctgggcaacagagcgagacactgcctcttaagaatttttttaaaaagtattctaacttatttaaccaaatcatcttttgctataaaaattatcactaaaggaggctgggtgtagtgtttcacccctgtaatcccagcacattggaagactgaggcgggtgggtcacttgagcccaggggttagaaactagccctgggcaacatgacgaaaccgtgtctctacaaaaaatacaaaaattagccaggtgtggtggcacacgcctgtagtcccaggtatggggaaagtgggggcagaggtgggaggatggcttgatcctggaaggttgaggttgtagtgagctgtgatcgtgccactgcattccagcctgggtgacagggtgagacacggtctcaaaaaaaaaaaaattcactaaagggaacaatgaaatacagttctgatgttgtagaaagacaacagaaataaaacagcctaaaaagtcccaacaatttgaacattatgaataattttatgtgtaatggattaaaatatgtcaaatatgtttaaatccttgggttaataatactttttaaaaatccaattcattatttgaaaagtcattaaaacaaaaaaaatcaagcaattatcctgctcttacaatataaactatatttcagggtatctaaatagttgatgagggtaagtttctcttatagaatcattctgcctaataaatgaaggataaagccaggattagactatcaccattttacaacccctaatgaaataatggatcgagataatgaccatcaatggctgttaatatgacaaaaagtgacaaccagacattatttgcctcctgacagtaaacagcaccacttatgaagtattcttgccccaactcaaatctgagccttctcaggcctctagacctattaatctattggaaatacagaggacagaacatgccaaagaataccataagaatacggtcactgcaatttagggacattatttggatcctgattggaataaactacagaaaaaactgctgagaatagaggaattattattaaatgttttaggcacaataatagcattctggttatgggtttttgttttttttttaaatatagagacaggatctcgctatgttgcccaggctggtattgaactcctgggctcaagcgatcctcctgcctggcctcccaaagtgctgagattacagatatgtgccactgtgcctggccagttttttgttttgttttgtttt[143 bp omitted]aaaggtactgaattgcttatggatggaatgatatctgagattgggtccaaaataaatgatggatggcagatactgcccatgagttgataattatttagactgcatgacaggtgcaggaaggatcattatactattttatgtaattttatatgcatttgaaattttctggccgggtgcagtggctcactcctgtaatcccagcactttgggaggccaaggtgggaggatcacttgaggtcaggagttcgaaaccagcctggccaacatggtgaagccccatctctactaaaaacacaaaaattagccaggcatggtggtgggtgcctataatcccagctactcgggaggttgggacatgagaatcgcttgaacctgggaggcgga[138 bp omitted]ttcttcttttcctttttcttggctttctttgctctccttttgttatcttcatctgcaaattaaagcacattacaattaagaaaaaaattttttaactctaaaaccgtagtacttttgagtaggtaactatcctattgctgtcccatttattgttacaaagaaattacctcattgaaacatttattgctatttgtcacgaactgtagggaggtactatgaacatagaaattaaagtcactaggttttgatgatatagggtattattattaattttattgtgtgagatagtgtggtggctaattaggaaaatgcctctttttacgggatgcatacagaaatatttagggtggaagtgtgatgatatttgtaattaactttgactatctcagtgaaaaacccatatttgaagcaaatatgtaaaaataccaacaactgccaaatctaggtgattaagtatatggtattaattatactattctcttcgcttttctgaatatttaaatatttttgtgataaaaagggaaagaaaactatgtgtgtgttggagaggggagagagaatcctttcctggagctcagtctaatggaggagacagataggtaaagagatcaatacaatctggaatgatagagggaagcttggggaacctggacacacagaggagtctcaaaatcagactgatttgaggagggtggctgaggaatggttgatcaggaaaggtgactcttaaagtagttctttgattacaaaagtaatgcatgcccattggtgcaatgagtaaaccaagctggatggagggagagactggcattgtaggcagagggcctctctaccaagtaacaagagaaagaacatggaatactgaggagacagaaagtagttttcagattacagaggatgttgcaagagagtgtaacagggtatatgtgattagagagaaatgagtcagggtctgaactttaccctgaaggctatggagtgctattgaaggattttaagtaggtatttggtgtatagggtattattactaattttattgtatgagatagtgttgtagttaagtataaaaatgcctctttttaagtgttgcatacagaaatatttgaaagttctgtcttcgagcactgaggaagagaagtgacagggagggccaggaaacttcggcgatatcagaggaaggtgaatctttgtgtaatgtgttaacctcagaggaggcaccttctggtcaatcatcagccaggagagagtacaaaaaggagactctttgtgatgcactaccccagatagggtgccttccacaaataggcagccagcatgaagtaggcactttatggcatacctttttgaaaactgtagaggtgctcattgggcatgagaattaaacaaaagagcccttccactgggccgatgcagccctgtaaggcttactttggtacagcccaaccccctgacttggtctggtgccatgtgccttgtacactttgcacaaccaatcccaatccggagtcagattgcttaggtttgaatccaaactgtgtgaccttagggatagtacttataacctgctctgtctccatttcctcatctataagatgtaccctacagttattgtatggattaaatggcaataataaatataaagcacttattggggtacctggcacaaggttagcaagtgttcaaaaactcttcagtattattattgttttcaggaaccttcttctaaaataagttttaagaagtaaaactagttttgaagcaaggcttgcagaatgctgttggcgttcttaccactggagtctgtttcagaatcagagtcactgtcgctatcttcagaatacttcttatgttttcttttcgatgattttttctttctccttttcttggacctttcttttgaacggctagacttcttctttttttcttctaagaaagtacaaattaaaaaattatattctaaaaaactatttctgaacatcaaaagaaacagacgatgggcaatttgagtaaaagcaaagtctaatgttcaactatttacaaactgatttttttaaatctctcaataaaatagcttgtattttaaaaataccctttttttaaaaataccttctgaagtagaagctgaagtagtgcttttctttggctcttcatcctccactggtgtatgttcatcagaactgaatttaaataaaatggttataagaattaggaaagtgatgagatatggaccatggagtgtaaagatatgaactccaaatttttcagtaacagcatcgattgtccaagaaccattaaaagcaagcattggagatcctaaggcagaacttgggaatcaaaaaaaccaaaacaacaacaaagcaagcactgaactactttcataaacgtgcagttcaagggtctaccatctttgtaataataaaataacttatcatttgcataacactttagagtttacatagtactatttaaacaaagcagcatggaggatttatattttcacaagaaaccacagggaaaaagtagagaaacaggaaccataggaaagattaaagaaactgggtataagaaggctgaagaaagactttataattttattttaagcacgtaaaagacaaatggtaaagcagcaactgttctgtctcctcagagcaaaaacctaacaaactacagtctaaagagatgttgttctgttgcagagaattctgaaaatgagtattattcaaattctacaatagtttagaaaaggagtttccacatcatataatcttttcctctgaagatca[141 bp omitted]aaaccccatctctactaaaaatacaaaaattagccaggcatggtggcatgcacctgtaatcccagctactcgggaggctgaggcaggagaatcacttgaacctgggaggcggaggt[132 bp omitted]tcaggttcttcaagtgttttcttttttttttcttttaaatagtcttgttatttgcccaggctggtcttgaactcccgggctcaaggaatccacctgccttggcctcccaaagtgctgtgattacaggcgtgagccaccgcacctggcctcttcaagcattttctaaaggtatctgtaagaacaagtttcagataataatgctttattatccaatcacaaattacaggtttacctgtcaagcacattgtctcaactcaacctaaagttggcacagaaacagagagggaagaagaaacttatgagtagcatcaaagagaaaagaaataagcaaaaagaaaaagcattaagtctgcagatagtattggatataggaatattaacaa[136 bp omitted]tggtgaaaccgccgtctctactaaaaatacaaaaattagccgggcatggtggcaggcacctgtaatcccagctactcgggaggctgaggcaggagaatcgcttgaacccaggaggcggaggttgcagtgagctgagaccgcaccattgcactccagcctgggcgacagagcaagactccatctcaaaaaaaaaaatctctttgtaatgttaatatctggcatgcaatctgccactgagtttagttgagaaaaaataattcaaaataatgtgtattatttaacaatgaacccttctattaataggaaaattatattccaggaattattttagattatgctaaaacctactagcaacatgttttaatctttagatatgttctatgtttttaaaacttaaggggtagaagaacataaatcacaagaaagaaaaatgtgagatatatttaaagttcttcacttaaacattttcacaatagattcaggatttaaacacatattataacattttaaaaatatattttttaaccacttactctggttcaggattctttggagaaagtccccatacttcaggagctcccaattctccaattctctctctctcacttaatctcctagcagataaagacatgtaaattataactcaatggctgagttgtttcctaaatatataatcaaattcaataggagtctagttaagccttttttccctttatattttaaacatggataaaaacttggtttaaatgtaaactcatcacttaaggtctgatgttctgatgatactatcaaatggtacagactatagaaatgatggcctgggagactgtcaagtgcatccattctgctgaatgcatgacacagctcttaactgctcatttcatcatctgtaatatgtgacagaaacagcttcacatttgtaagtaacttcatttgtttacagatttatgaaaggtgaagagaagtctcttttgatatggtcaaaccttcagttttcagaaatcgaggaattaatgaagaaaataaaaatgatgcattagacgtagaaaacaactgaagttctg[134 bp omitted]tcctgcctcagcctccttagtagccgggattacaggcatgcgccatcacgcctggctaatttttgtattcttagtagagatggggtttcatcgtgttggccaggctggtctcaaactcctgacctcaggagatccacctcagttgctgggattacaggcgtgagccactgcaccgggcccgaaataaaagttttttatttttttgtagagatgaggtcttgccgccaggtgcggtggcacatgcctgtaatcccagcactttgggaggctgaggcgggcggattgcttgagatcaggaggtcaagaccagcctggccaacatggtgaaaccccgtctctagtaaaaatacaaaaattagccaggcgtggtggcgcatgcctgtaatcctggctactagggaggctgaggcaggagaatcgcttaaacccaggaggtggaagtttcagtgagccaagatcgcaccactgcactctaacctgggagacagagcgagactccgtctcaaaaaaaaaaaagaggtcttgctttgttgtccaggctgatcttgaactcctggcctcgagcaatcctcttgcctcagcctcccaaagcgttgggatcacaggcatgagccactgcacctagtcaaaaagtttcatttaacaaaaaatatacttggggctgggcgtggtggctcacgcctgtaatcccaacactttgggaggccgaggcaggtggatcacctgaggtcaggagttcaagatcagcctggccaacatggtaaaaccctgtctctactaaaaaaaatacaaaaattagctggacacggtggcatgtgcctgtagtcccagctattcagaaggctgaggctggagaatctcttgaaccctggaggtggaggttgcagtgagccaaggtcacgccactgcacatgacagcctgggtgatagagtgagactcttatctcaaaataaaaaaccaaaaaaaaaaaaaaaaaaactatactcaatgagatacaaggtttgttccctctctgttttccttttagttcctttttggaaaaggagtgcattttgtatctattctttgaaggacactaaaatttgtttcttcttttgttttatgcctatggtttcttctgttttaatttttgttattcctcataaactaaaaaacaaaacaaaacaaagactaaggctcattctctcaaattttagctgcttgtgactccatttgtttttaaaaatccttccaaaataaatataattgcaatgagtttttgtataaatcgtttttgcctccttaatcaggggaaaaggtattataactatgcagagtcagactgagagggtttcccacctgaagtaacagacaatttaaaaggtaacatatttatagctgtacttggaatgtatggatatcgggggaagaacgcctaccaggctgtaaatagcaggaagtcctgttgtcacctggtttcatctgtaatgttaagataaattattggccgggcccagcactttgggaggctgaggctggtggatcacctgaggtcaggagttcgagaccagcctggccaacatggcgaaaccccgtctctactaaaaacacaaaaattagctgggtgtggtggtgcatacctgtaatcccagctattcaggagattgaggcagaagaaccacttgaacccaggaggtggaggctgcagtgagccgagactgcaccactgcattccagcctgggagacagagtgagactccatctcaaaaaaaaaaaaaaagataaattatttattttctaaatgtacatatgcaagtttcatccaagcacttctgacatcttttggtgaggattctccaagaagaaactatttactttttgactgacatagcctgtgggtatgtttctgaaaaatgtaacttggagagatgggtctccaacctaactcaggactgtttttactgtttttgctcccatgcatgaaacattaatagctaacacttatggaatagttatgttccagccacttaattattacaatccccaaatccctagtacttattttatcccctttttaatccatagtacttattttatcccccttttaatgatgaagaaatggagcccagagaggttaagtaacttgaccaaggtcacacagctattaagtggcaaataaaggcttcatactcagtctgattctggagtttgtccttttcctttctttcttcctgttcttctctttgtttttttttgtttgtttgtttttgagacagcatctccctctgtcacccaagctggagtgcagtggtgagatcatggctcatggcagccttgacctctccagctcaagtgatcctcccacttcagcatccccagtacctgaaattacaagcacatgccaccacgcccagctgatttttaaaacactttttgtagagacagggtatccctatattgcctaggctggtcttgaactcctggattcaagtgatcctcctgccttggcctcctaaagtgttgggattacaggcatgagcctctgtgcccagccaaaaaatgcatagttttaaggagaaaggaaaaggctcataattattgctgtgtaagtcttaatatcttgtttattgttaaattatgtgtcaggcactgtactaagttatttacgtgcacttatatgtttaaaaaaatgagaaacttagaaatattacaggcattgagaggtaggttaaagttccaacagttgggagatgtcttgagtctttttcttccggcagtgggaggtaataaagtatagtgatgaaaaggacaggctcggcagggcatgtggggtcatacctgtaatctcagcacttccggaggccaacgtgggaggatcacttgagcccagaaattcgataccagcctgggcaacatggtgaaaccctgtctctaccaaaaaatacgaaaataagccgggtgtggtggtgcgcacctatagtcccagctatgagggaggctgaggtgggaggatcacttgagcccaagaaggtggaggctgcagtgagccaagattgcaccactgcactccaacctgggcgacagagctagaccctgtctcaaaaacaaaacaaaacaatccccaagctatgcatttttccactccaatactcactttgattagagatctagtctcatcctggcgtcatttttcgaggtcaagactgagaccacttaacaagaccttcctcaaagtggggtcatctatagcttatcagatcacttttcctacatgcatctaatcgtcttgtctgaggggaaggtttatttcctctccaacttaaacccttgatttcattccttcctaattccccacaaaacgtttctacataaatatcctgttatctcagacctgtaagttccttcattcaacaagcaatggttgagcgcctataaagtaccaggcacttagaattctgtgatcagaattctcctccgttcactggctcctcctttccatgagctcagtctagtggggaatacaaatatattcacgaatgataatgacacaaccaggtaaatgctacagttctggtaggtctgaactctcggcaatattcgctaacaagacaggaggcggaagggggtagcgggagaccagggcactatatgaaggggcctgagggtaagggaaaatgaaaaggacgaataaagggttgtcgtgggtggattaaagaaagggatgaaaatgggcgcaaggcaagcagagtgagcgaaatgcgaatagtcagaagcggaatgaatgatagatcggactccaaaggcacgtaggctcgtacaagagaaagtgcggccgtctcactcacttctgccgcaggctctcctccctctccttgtcgaggaggctaggccaaggcttgtcgctcccgtaggggcgcgagtagctgccgtaatagactgacgaggaggcagaagcgaaggggatgccccggggcgcagagggccgctctctagaacgcgaccgcgagcgtgagcggtaggactggtttcgggagccttggctgaggccacccagctgatgggtgagtccattccggtccccggaccgagagcaagagtgcgagcgagagcggcggccccgcggggagcgggcagatttgctgggcttcggactcttcgacgaactgcgacgtcttccccccgagcccgaggcctccctatccgggctgcgtgagccggacaccggagccatggctactggggggccccagcagccgtgggacaagggggcgctctcgcgagcctaggaagatgtctgttgccttggttcccgggacctgccgctgcggaacagcccaaatctgaggaaaccttggacacagttctgggtacttctgcaaaacccttccccggatctaggcggtcgtcaccgacaggaagcgatgtgtgcatcaatataaataagccggtggggcaactagattgcgtgcatccttccagttccgagtgaggctcctcaagtctaagcaagagaccaagttctttctcagccttgaacttgaaacacttgaagggaagtatatatttcaaacacaatatacagtatacatttcactgagtggccgtatgaacaagacagttaattctgcttgtgtttcctgtgctttctgtgtgtatttatatataaatgtgtgtgtgtgtgtgtatgtcatgtatgaaagtatgaatgtgtattttctttttctttccaatcccaagcaaatcgggagggtttttcgcgactggggattagctatggtgtctaagccccatattgccgtgttagcttagagggcgcaaattttgttaatgactcgcgcctgataaacttcaattaagtttcccgcctagagaaaaactgcatacttatcccctagccaccgtctccaccaatatgccccagcaaaaggaggttttttttttttgagactggaactcactctgctcactctgtcgcccaggatggagtacagtggcaagatctcagctccctgcaaacctccgcctccccgggctcaagctatcctcccacctcagcctcctgaatagctgggattacaggcgcatgcgacaccaagcctgggtagttttttttttgaggggggtcgggggaaacagggtttcaccttgttgcccaggtggtcttgaactcctgggctcaagcgatccgccagcctcggcctcccaaagtgctaggattataggtgtgagccactgcgtctggcttgtatttttttccccaaaaagtgtcattttattttttatttttttatttttgagacaagggctccctctgtcatccaggctggagtgcagtggctatcctggctcactgcaacctccgcctcccaggttcaagtgattctcctgcctcagcctcctgagtagctgggattacagacatgtgccatcatgcacagctaattttttattattttttaaatttgtacaaatctatgggatacatgtgaaattttgttacatgtatataatgtgtagtgatgacgtcagggtatttaaggtgtccattatctgagcacaatacatttttgttaagtgtactctcggcctggtatggtggctcacgtctgtaatcccagcactttgggaggcagaggcgggtggatcacttgaggtcaggagtttgagaccagcctggccaacatggcgaaaccctgtctccactaaaaatacaaaaattagctgggcctggtggcacgtgcctgtaatctcagctactagggtggctgaggcacgagaatcgcttgaacccgggaggctgaggttgcagtgagccgagagtgagattgcaccactgcactccagcctgggcaacagagtgagactgtgtttccaaaaaaaaatagtgtactctcactctaccatgctgtcaatatcaaacattgaatttggggctgggcatggtgacttacacctgtaactccagaaatttgggaggccgaggcgggccaatcacttgagcccaggagttggagaccagcctgggaaacatagggagaccctgtctctacaaaaaatttaaaaatttggcgagtgtggtggtgcatgccagctactcaggagactgaggtgggaggaacacttacttgagcccggaaatcgaagttgcagtgagccgtgattgatccactgcactccatgggcgacagagtgagacactgtcttaaaacaacaacaaaaaccattgaatttatttcttctatcttactgtatgtttgtaccctttaacctatttctcttcatccttctgcttcctcccacataccctacccagcctctattatctatccagcaaaaggaatttgtaatcccctctttgtccagctccttaaactagtctcattgtatgccagcccagcaatatagagttaaggatcagtattcctattctttttttttttttttttttttttttacatggagtctcgctctgtaagcaggctggagtgcagtggcgtgatcttggctcactgcaatctctgcctctagggttcaagctattttcctgcctcagcctcctgagtagctgggattacaggggcgtgccaccatgcccagctaatttttgtagttttagtagagacagagtttcaccatgttgg[131 bp omitted]ttgtgaaacagtgtctggctccctcacccagactggagtgcagtggtgtgatcttggctcactgcaacctccacctcctgagttcaagggatcctcccacctcagcctcctgagtagctggcatgtgccatggttcgctaatttttaaattttttgtagacatggggttttgccatgttgcccaagctggtcttgaactcatggactcaagtgatcctcacacctcggcatctcaatgtgctgtcattacaggcttgaaccactgcacctaggcctctactgtttttaaatcaaagggcattccaacattaattctactgatttcgacttttttttttgagacagagtcttgctctgttgcccaggctggagtgcagtggcaggatcttggctcactgcaacctctgcctcctgggttcaagcagtcctcatgcctcagcctcccaagtagctgggattacaggtgcccaccaccatgcccaggtaatttttgtatttttggtagagactgggttttaccctgtaagccaggctggtctcaaactcctgacctccaatgatctgccggcctccgcttcctaaagtactgggatcacaggcgtgagcctccatgcacagccctcaatttggatttttgaaggtacataggtttgctgaagaaattccaagtccagcctgccagtagcatgatggcctctgggattttcctaagaagtaatttatcagatcatgaaaattaatgccaattgattatcagaaatctcctttttttggaatttaagggaaagacgtatgaaataatgttaaatggaaagagtggaccacactattggatatcttctatgtataactaatttgtcatggggccaggtccaaaaacttaatcgagtaagagaaattctgtgatttgggatggagattggggagaatttctaataagaaagttttcaatggaaaacctactgcctaacttttgcgacaacaggcagtacaccttcacatcagttgcctataaaaccaactctgcaacagtgattggtctacctgccccatggctggtggacatgtactttagttggaaagagaaaacccctactcctgcacatctgaatggcatggtgctcttcttgccaggtatcctgggagcagcctgtgtttcatgagttggcagtgagggggagctagagcacacagggaggtgcagacagccagtgggatcaggcttgcagagtttgggtcctgccactgcactccagcctgggcaacctctgcctcccaggttcaagtgattctcctgcctcagcctcccaagtagctgggacttcaggcatgcgccaccatgcccagctaatttttgtatttttagtagagacaggatttcactgtgttggccaggctggtcttgaactcctgacctcatgatccgcctgcctcaccctcccaaagtgctgggattacaggcatgagccaccgcgcctggcctattcttctttaaattttttttttttgagatgggggtctcactctgtcacccaggctaaagtgcagtggcactatcttggctcactgcaacctccgcctcctgggttcaagcgatcttcccacctcagcctcccgagtagcggggacaacaggcgcataccaccatgcctggctaagttttgacatttttggtagagacaaggtttcgccatgttgcccaggtgggtctggaacccctgagctcaagtgatccgcccacctcggcctcccaaagtgctgggatcacaggcgtgagccacctcacctgacctgatccattctctacaggaattaaaccatttgtgtgttatgggatatggaggtattcagcttccattcactactcctcttcaaagtctgagactctgcagctgtctgggcaggtgcatggctaacacccagcggactgaggcagggatctgggttgtggaaatggaatttaaggagtgggtgttagggggactcttgtagtttgtgtccatttgaatttgaggatgctttccaattatgccaacaattgttttagagactgcgagattaaaacaatgtttttaatcactaacctcttttgaaagaatttgcaggatcaaaacccgaactacataatttctaaaaagaattttcttttagaatacttcttagtcaatacagacctgtgatccctgataacttaactggcgtgctggctttgtcagttcctctaacacctcacttatctgcatttcttctctgataatgaattgctactacttctacaggaagaaattggatgatattaggcccctaaatatggaaaatttcgcactcttgggttagcctatttgaatctcacattggaaagactgtcataaatggagaactgtttctaatttgactccactaggaggagctgtatctaccaacaggtagaaatatggctggaacttgcaggtgtgttctgaggaccaaaagcacaggataaaataagtgatgtgaccattctaggatatattcgagctaaagatcgtgtgtgctcatgcgcacccaaaagatagagagaggaacattgaatgaagcagagctcagtgctagacatggatggagaatttgagtgctctgctgcccaccgggtccctaggggactaggatgttagccagggggcgaggccgccccaaaacttggccaaacaactgatatcctaaagcacagccaataatcacaatagacacaatagttgtgtcacagattccaaatacaattgaacagcttccagtttgcgtctatgtgagaaggggcaaaaaagggaaagagggttgatcacagagagaagtaagatataaccctctgttcctgtgttgcttaactccaattaactgacattccttatttgcagtatctagagtacaaaactttggtgctgatagtgagaaatcaacgtgccgcacatttgctattcctgtaagggcaaatgttaaatatgggactgtggcatttgattccctcatgctccccccttcttttcctcctccttcccttctgtcccttccccctctcttcctgtagctttaaaaatgaaagaacaggacttcctcagaatgcagttttgcaaaatttaactaaacactacatgaagtactcgtatctattatcggataagccatgctaataaactgaaaacccaaaataggcacaccctgaaaacattggactcagtgagcagagatgctagctgtagtcatgctttgatcttgccttgtttttttttttaattaatagactttatttttaagagcagttttaggtttacagaaaaatggagcagaaagtacagagctcccatatactccccctgccctgccccactccacctccacagtttcctctattatgaacattttgttttggtatggcacatttgtttttttgtttatttgtttgttttttaggcggagttttgctcttgtcgcccaggctggagtgcaatggcgcgatcttggctcactgcaacctctgcctcctgggttcaagtgattctcctgcctcagcctcccaagtagctgagaccacaggcatgtggcaccatatccagctactttttgtattattaatagagacggggttttaccatgttggccaggctggtc[137 bp omitted]atgataattaactaaagtctgtagtttacattagggttcattctttgtgttctactttctatggattttgccaaatgcataatgtcatgtacctaccattacatcatcatacagagcagtttcactacctttaaaatctctctgtgctctacctattcatccttccttccttaccctctcccttcttccctgccaaacttctggaaactgctgatctttttactgtctctacagttgtactttttctagaatgccatagtattagtcagggttctctagagggacagaactaattatatatatacatatatatgtgtgtgtatatatgtatacatatattgtgtatatacacacatatacaatatatgtgtatgtatactatatgtatatatagtatatatgtatatatgctgtatatgtatatatatactatatatgtatatacatatatattagcagtagaactaatagtactatatatatgctattagtagaactaatagcatatatatatatatatatatatatatatatatatatatatatggagtttattaaggagtattgactcacatgatcacaaggtgaggtcccacagtaggctgtctataagctgacgagcaaggagcctactccaagtcccaaagctgaagaacttggagtctgatgttcaagggtaggaagcatccagcacaggagaaagatgtaagccagaagattaaaccagtctagtctgttcttctgcctgcttttattctggccccctggcagctgattagatggagcccaccctgactgagggtgggtctgcttctcccagtccactgactcaaatgttaatctcctttggcaacaccctcatggacacacctaggaacaatactttggaacattcttcagtgcgatcaatttgacactcagtattaaccatcacagccatatatttgcaatcagactggcttcttccacttggcaatgtgcatttcacattcctccatgtcttcttgtgacttgacagttcatttctttttagtgctgaataatattctattgtatggatacaccacaatttgtatatctattcacctattgcaggacatcgtgattgtttccaagttttggcaattatgtataaatctgctataaacatttatgtgtaggtttttgtgcagatatatgttttaaccttacttgggtacatacctagaggtgtgattactggatcatatggtaagacgatgtttagccttgtaagaaactaccaaactgtctttgaatgtggctgaaccatttggcattcccaccagcaatgaatgaaaattcttgttggtctacattcttgtcagcatttggtgctgtcagtattgtggattttggccattctaatagctgtgtagtggtatctcattttaattttcaatttgcaaactacatatgatgttgaacatcttttcatgtgcttgtttgccatgtgtatgtcttcttttggttcacatctttttaattgggttattttcttattgttgagttgaagagttccttgtgtattgtggatacaagccttttatatgtattttgaaaatacttcctttcagtcagtggcttgtattttcattctctctctctctctcttttcttttttgagacagagtcttgctttgtctcccaggctggtgtgcagtggcacaatcttggctcactgcaacctctgcctcctgggttcaagcgattctcctgcctcagcctcctgagtagctgggacttcaggtgcccgccaccaggcccgggctaatttttgtatttttagtagagacagggtttcaccatattggccaggctggtcttgaactcctgaccttgtgatctacctgccctggcctcccgaagtgctgggattacagtcatgagccactgcgctcagccccattctcttaatgatgttttttgtaggacagatgtttttaatcctaatgaagtccaagttatcaatttttttttcatggaatattctgtttgctttttacctaaaaacttattgacaaaccccaagtcacccagattttttcatatgttatcttcttgaagttttatagctttacattaatttttttttttttttgagacgaagtctcgctgtgttgccaaggctggagtgcagtggcgagatcagggctcactgcaatctccacctcctgggctcaagcaatcctccacctccgccttctgagtagctgggactacaggcaggcgccaccatgcctggctaattttttttttcttttggtagagacagggttttgccatgttacctaggctggtctcaaactcctgaactcacgagatccagccgcctcagcctctgaaattgctgggatttcaggtgtgagacactgcacctggcctagttttacattttatatttaaatctgtgatccattttgagttactctttgtgaaaggtgtaagattcatttttttgcatgtagctgtccagtttttccagcaccatttgttgagaagactatcctttctccattggattgcctttgttcctttatcaaagatcagttaactatatttgtgtgggcctatttctgagctgtctgttatgtctcatcaatctattctttcaccaataccccactgtctagattactgtagctttataatagtaatatcttgttgttgggaaatgtcagtcctctcactttattcttattcttgagaattaatttggcaatttctgggtcatttgattttttatataaactttaaaatcagttagttgacttccacaaaatgatttgcagggattttgatgggaattgcattcaatctacaggtcaagttgggaagaagtgacatctaaacaatattgagtcttcctattcgtgaacatagaatctctcttcatgtatttatttatttttattaaattttttaccttgcagctcaaaggatctccatttagatctttgatttatttcatcagagttttgtagttctctgcatatagatattgagatataacacatattttgttatgttatacctaagtatttaattttttggtgctaatataaatggtattgtgtttttaatttcaaattccagttgctcattgctgacatataggaagatgattgacttttgtatattaaccttgtgtcctacaatcttgctataattgctcattagtttcaggagtgttattttttattgttgttaattccttgggattttctacacatataatcatgtcatctgtgaataaggacaattttatttttttcctctcagttcatatactgtttattttattttattttattattgcattaggcaggacttccaggacaattgtgaattggagtggtgagaggtgatgcctttgccttgttcctgatcttaaggggaaaacatctagtttctcaccattaagtgtaatgtaggcatttttagatgtccttatcatggtgaggaacttactctctcttcctgggtttctgagagttcttaacatgaatgggtgttggattttgtcaaatgcttttttctgcatctgttgatatgatcatgttatttttcttctttagcttgttaatgtgatgggttacattaattggttttcaaatgttgaaccacctttgcatgcgtgaaataaattccacttagttgtggtgtataatttttttgtatacattgctgaatttgatctaacattttgttgaagattttacatctatgttcatgggagatgttcatttgtggttttccttgcttgtaatgcatttgtctgattttgatatttgggtaatgctaacctcagaggatgagttaggacgtatttcctatgcttctattttttagaacagattgtagagaattagtataatttcttccttaaatgtttggtagaattccccagtgaaactatcttggccaggtgctttctgttctggaagattattgattcaattaaaaatacatatagatgttgagattgtctgtttctccttgtgtgagttttagtagattgtatctgttgggagaaaagctgagtgtagggagaaaagctgagtgtagggagagaagctgaggcagggcttgcatgtctgctagacttgctggctccttacttctagcactcccattatcccaagtagccatatgtttttcattcacttgatacactgtttcctttcaacccccacatcctcaccacctgtttctttgagcactaataaatagcgtgggctcccagagctcagggcctttgcagcctccacacttgtgatggcccccggtcccactttctctcaaactgtctttttctcaatcctttgactccactggacttcatcgtccccacaacctggtgttgggtctgatcatcccaacagtatctttcaaggaattggtccattgcatctaagttattaaatttgtggccataaagttttgcaaaatattcctttctcatcattttaatgtccatgagatcggtagtaatgacctctctttcatttctgatattagaaatttgtttctgggcatggtgtctcatgtctgtaatcccagcactttgggaggctgaggcagaagatcccttgagcacaagagtacaagtttacagtcagcctatgattgcatcactgcactctagcctgggtgacagagcaagacttttgtcttccgccaaaagaggaaaaaaaattatgttttgtctcttttttcccttggttaccctgacttgatatttaccgattttgtgatcttttcaaagagccaacttttggttttgttgcttttcttgttttctgttttaaatttccttgatttttgctctgagtttttattccattttttcttctgctttcttttcattcaatttactcttctttctctagtttcttaaggttgaagtttagattatgaattttagttcctattttttttttttttttggcagagtttcgctctgtttcccaggatggagtgcagtggcacaatctcggctcactgcaacctctgcctcctgggttcaagcaattctccagcctcagcctcccgagtagctgggactacaggcacgtgccac[131 bp omitted]ccggccctgtttttctaatgcatgcactaagtgctaatgaattttcctctatgcattgctttcattgattaccacacattttgaaaagttgtattttcattttcacgtagttcaaaatatttttcaaattcccctgaaatgtcttctttgatccatgtgttctttagaagtgtgtcttatggcaaagaagtggtctaccttgctgaatgtcccatgcgagtttgagaagaatgtgtattctattgtaggataaaatgctctataaatgtcaactagatccagtttattgatggttcaaccatatccttactgattttctgcctgctggatttgtcaattactgatgttgacgtgttgatgtctccaagtataatagcgggtttagctcattctccttgcagttatgtcagttttcgccgcacatatttggatactctctcattagacacatacacattaaggattgttctgttttctggagaattgactcctttatccttatgaagggcccctctttatccctaataattttccttactctaaggtttgctttgtctgaaattaatatagctactccggctttctttttctttttcttttttgttttttgagacaagagtcttactctgtcacccagattggagtgcagtggcatgaccttggctcactgcaatctccgcattccaggtttaagcgattctcgtgcctcagcctcccaagtatctgggactacaggtgcatgcaactgtgcccggctaatttttgtatttttagtagagatgggaggtttcactatgttggttttcactatgttggccaggctggtctcaaactcctggcctcaagtgatctagccgcctcagcctcccaaagtgctggtgtgtctggaatttgttccttccagtgggttcttggtctcgctgacttcaagaatgaagccgcagaccctcgtggtgagtgttacagttcttaaagatggtgtgtctggagtttgttccttcagatgttcagatgtgtccagagtgtcttccttctggtgggttcgtggtctcactgacttcaggagtgaagccgcagaccttcgcaatgagtgttacagctcttaaaggtggcacgtccggagttgtttgctcctcctggtgggtttgtggtcttgctgacttcaggaacaaagccacagaccccggcagtgagtgttatagctcttaaaggtggcgcacgtccagagttgtttgttcctcccagtgggtttgtggtctcgctgacttcaggagtgaagccgcagaccctcgcggtgagtgttacagctcataaaggtagtgcatacccaaagagtgagcagcagcaagatttattgtgaagagcaaaagaacaaagcttccacagcgtggaaggggacctgagtgggttgccgctgctggctcgggtggccagcttttattcccttatttggccccactcacatcctgctgattgatccattctacagagtgctgattggtccgttttatagagtgctgattggtccattttacagagtgctgattggtgtgttttcaatcttttagctagacacagagtgctgattggtgcgtttttacagagtgctaattggtgcatttacaatcctttagctagacacagagtgctgattggtgcatttttacagagtgctgattggtgcatttacaatcctttagcaagacagaaaaattctccaagtccccacctgacccagaagtccagctggcttcacctctcactgggattacaagtgtgagccaccgaacctggcacagctttcttttgattagtgctactatagcataatctttctccatcctttttcagaaaaaactcctgtctccaaatcaaaaccattcttttacttttgatccatgtctttatattttatttatttatttatttatgagacaaggtctcactctgttgcccaggcaggagtgcagtggcgtgattatggctcattacaacctcagcctccctgggctcaggtgatcctcccacctcagccttctgagtagctgggactacaggcacaggccatcctgcttggctaatttttatattagcaggggttttgccatgttgctcaggctggtcttgaaatcttgagctcaggtaatctgcctgcctcagcctaccaaagtgctgaaattacaggtgttaactaccacacctggcctgtttttgtatttaaagtgagttttttgtagccagtatagagttgggtcttgtatttttatccactctgagtgtttctgtcttttttttcctcttcatgctcatatcatgaagtttctgtctgtcttttaatttgtgtatttagatcattcacatttaaagtgattattgatgtatttggattagtgtctaccatatttgtaactattttcaatttgttgcctttgttcttggtttctattttgtcttttactctttttctgccttctttggttgtaattgagcttctaattatgattccattttctctcctctcttagtatatcagttatacttcttttttaaaattttatttaatggtttgtgtgtgtgttttctttttcttttcttttttttttagggtaaggtctcactctgtcactcaggctggagtgcagtggcacgatcatagctcactgcagccttgacctgctgagcttaagcagtcatcctgtctctgcctcctgagtagctggcagtacaggtacacgccaccacacatggctaattatacttcttaaaaatatttttagtgttgccctagtgtttgcaatatgcatttactactaatctaagttcactttcaaataacactatatcattgtatgggtagtacaactattttataacacagtattcccaattcctcccttataacattgctgtcctttataacattgctgtcattcatttcacttatctctaaactataatcactgaacccattgtttctataattaatttgaacactgttatcagttagatcaaataagaaaaatgagatatttattttattttacctttatcgatgatttctctaatgtttttcctttctttatgtaaattggagtttttggtttttttttttttttgagtctcgctcttgtctcccaggctggagtgcaatggcgtgatcttggctcactgcaacttcctggcttcaagtgattcgcctgcctcagcctcccaagtagctggcactacaggcacctgctacgacgcccagctaatttttgtatttttaggagagatggggtttcaccatgttggccaggctggtctcaaactcctgaccccaggtgatctgcctgcctcggcctcccaaagtgctggaattacaggcctgggccactgtgcccagccgatcatttttctattctttgaaaaacttttggccgggcgcagtggctcacgcctgtaatctcagcactttgggagg[134 bp omitted]gactgaggtaggagaatcacttgaacccgggagttggaggttgcagtgagccgagatcgtgtcactgcactccagcctgagtgacagagcaatactctgtctaaaaaaaaaaagaaaaaaaaaaacttttaacatccattgcaaagcggttatactggtgacaatttctcccagttttgtttgtctgagaaagtctttatcctcttgaagggtaatatcactgggtgcagaattctaggttgttggtgcttttctttgaatacctcttcttgctcctctataggtaaggtattgttttcatccatcttcttttaagagtttctctttgtctttgattttctatagtttgaatatgatatgcttaaatatagattattttggtatttattctactagatgttccttgactatattggatctctggtttgctctctgtattaactttgaaaaattttctgccattattatgttaattatttcttccattcctttctctcttctctcattatgcatatgttacacctttgtaattgtccagagttctttgatattctgtttgttttttgtttcattattttttctctttgcttttcagtttgggaaattcctattgtcatattaagagcttttcttttcttttcttattttactttatttttgagacagcgtctcagtctgtcatccaggctggagcacagtggattgatcatagctcactgcagcccccaacaccagggctcatgcaatcctaccgtctcagccaccacacctggataattttgtttaagagatggggtcttgctatgttgcccccgctggtctcaaacttgcctgcagcaatcctcccactttagccccatgaagtgctgggcttacaggtgtgagccaccgtgtccaacccacatatggaagtctattgtcatatcttctagtgtactgtttctttcctgccttctctagtctaaccataagcccatcagagcattcttcaattctgttactatgtttgtgatttgtagcatttcttttttaatttttttcttagagtttttatcactctatacattactcatctttcttgcatgttatctgctctttccaatagagcacttagcataataatcatagttattttaaattcccaacctaatcattctaaaatctgtgctgtattttagttgggttctgatgcttgcttcgtctcttcagaacatgatttttttgagacaaggtctcactctgttgcccagggtgaactgcagtggcatgatcatggctcattgcaacctcctgggctcaagcgatcttcccacctcagtttcccgagtagctagggtctacaggcatgtgccaccatgcctggctaatttttcttattttttgtagagacaaggtctcactatgttgtccaggctggtctagaacttctgggctcaagtgtttcacttgctttgacctcctgaagtgctgatattaaaggtgtaggccactgcacctggttctagaatatgttttttgagttttagcagtcttatacatttttgttgaaaaccatacatgatgtactgggtagaaagaactgaggtaggctgggcatggtggctgtgcctctctattcccagcacttcgtgaggccaagtcaggaggcccacttgaggccaggaattcgagaccagcctgggcaataatatagtgagaccctgtcactacaaaaaaaggaaaaataaaaaagcactgaggtaggtagttcttttgtgtgaggttttatggttctctggctaagaattatgctgtttactgttggccgtagctttaagtgtcagaagctaaaatttcttgtagggcccttgtctttgtcttctttgttgtctttgagtttttccagaggctccttaaataggatctgaggcttgcagtcttttcagctgtaattcacttataatctgtggttattatgcaggattcttactgatgtggtggtaaggttgggaggagcacaagcattctatcatcccatgattagatctcagtctttcactgagcctgtgtccctgggctgtgacctttacaagtccttctcagtgtccccacccatccctttagcctagatggaaggctagacagggctggagtttagtacttcctttccctgtgtttggtcaggctttggggaaacagaacttggttaggctctggtaaaatagtttcctctcagggtagtccttggctagggaaaacagagatctctgggcatatttcaaaatgattgcttttcttgtctacctgctggaagcagagagggattcccaccccctcccttcacagtgacgacttggtggggcttctggagataaaactcatgaaagtgtggagtccccttaaagctgcccccacccttgaagttttaactctctagataggccatactgagcttctagaagttcatcagaacagttgttcctacagagtgttcctactcgtactggctccaactgtgggtttctgctgatggccttctactcttggtaaatggtaattctctgtatctgcctgtctgtctctagttttcatgccttccactgtaattctctgatatatctaggaagagttatttttagtttgttcagcttttttcttgtgaggacaggaatgatgacttccaagctctttacgtgttggactgcaaacgcgcaagtccttgtcttgctgtttaaagtgtgagaatttgaggtttccaagatggccgaataggaacagttccagtctacagctcccagtgtgagtgacgcagaagatgggtgatttctgcatttccaactaaggtaccggattcatctcaatggggcttgtcagacagtgggtgcagcccacggagtgtgagccgaagcagggcagggcatcgcctcacttgggaagtgcaaggggttgggaaattccctttcctagccaagggaagctgtgatagacggtacctggaaaatcaggacactcccaccctaatactgcacttttccaatggtcttagcaaacagcacaccaggagattttatactgcgcctggctcggagggtcccacgcccacggagccttgctcactgctagcacagcagtctgagatcaaattgcaaggtggcagtgaggctgggggaggggcgcctgccattgctgaggcttgagtaggtaaacaaggcggccgggaagctcgaactgggttgagcccaccacagctcaaggaggcctgcctccctctgtagactccacctcttggggcaaggcatagctgaacaaaaggcagcagaaacttctgcagacttaaacgtccctgtctgacagctttgaagagagtagtggttctcccagcatgcagtttgagatctgagaatggacagactgcctcctcaagagggtccctgacccccgagtagcctaactgggaggcatctcccagtaggggctgactgacacctcatacagctgggtgcccctctgagacgaagcttccagaggaaggatcaggcagcaacatttgccatcctgcagtatttgctattctgcagcctgtgctggtgatacccaggcaaacagggtctggagtggacctccagcaaactccaacagatctgcagctgagggtcctgactgttagaaggaaaactaacaaacagaaaggatacccacaccaaaaccccatctgtacgtcaccatcatcaaagaccaaaggtagataaaaccacaaagatggggagaaaccagagcagaaaagctgaaaattctaaaaatcagagtgcctcttctcctctaaaggaacacagctcctcaccagcaatggaacaaagctagatggagaatgactttgacgagttgagagaagaaggcttcagacgatcattaataacaaacttctccgagctaaaggaggatgtttgaacccatcacaaagaagctaaaaaccttgaaaaaagattggaggaatggctaactagaataaacagcatagagaagaccttaaatgaattgatggagctgaaaaccatggcacgagaactacgtgacgaatgcacaagcttcagtagccaattcgatcaagtggaagaaagggtatcagcgattgaagatcaaatgaatgaaataaaatgagaagagaagtttatagaaaaaagagtaaaaagaaacaaacaaagcctgcaagaaatatgggactatgtgaaaagaccaaatctatgtctgattggggtacctgaaagtgatggggagaatggaaccaagttggaaaacactctgcaggatattatccaggagaacttccccaacctagcaaggcaggccaacattaaaattcaggaaatagagaatgccacaaagatactccttgagaagagcaactccaagacacataattgtcagattcaccaaagttgaaatgaaggaaaaaatgttaagggcagccagagagaaaggttaggttacccacaaagggaagcccatcagactaacagctgatctctcagcagaaattctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaaccggtaccagtcactgcaaaaacatgccaaattgtgatgaccatcgatgctaggaagaaactgcatcaaataacaagcaaaataaccagctaacatcataatgacaggatcaaattcacacattaccatttttttttttttttgagacggagtctcgctctgtcacccaggctagagtgcagtggcgcggtctcggctcactgcaagatccacctcctgggatcatgccattctcctgcctc[224 bp omitted]gctccaattaaaagacacagactggcaaattggataaagagtcaagacccatcagtatgctgtattcaggagacccatctcatgtgcagagacacacataggctcaaaataaagtggtggaggaaaatctaccaagcaaatggaaaacaaaaaaaagcaggggttgcaatcctagtctctgataaaacagactttaaaccaacaaagatctaaagagacaaagaaggccattacataatggtaaagtgatcaattcaacaagaagagctaactatcataaatatatatgcactcaatacaggagcagccagattcataaagcaagtccttagagacctacaaagagacagagtcccacacaatagtaataggagactttaacaccccactgtcaacattagacagatcaacgagacagaatgttaacaaggatatccaggaattcaactcagctctgcaggagctggtttttttgaaaagatcaacaaaattgacagaccactagcaagactaataaagaagaaaagagagaagaatcaaatagacacaataaaaaatgataaaagggatatcaccactgatcccacagaaatacaaactaccatcagagaatactataaacacctctacacaaacaaactagaaaaatctagaagaaatggataaattcctggacacatacaccctcccaagactaaaccaggaagaagttgaatccctgactagatcaataacaggctctgaaatagagacaataattaatagcctaccaaccaaaaaaagtccgggaccagacagattcacagtcaaattgtaccagaggtacaaagaggagctggtaccattccttctgaaactattccaatcaatagaaaaagagggaatcctccctaactcattttatgaggccagcatcatcctgataccaaagcctggcagagacataacaaaaaaagagaattttagaccaatatccctgatgaacatcgatgcaaaaattctcaataaaatactggcaaactgaatccaggagcccatcaaaaagcttatccatgatgatcaagttggcttcatccctgggatacaagtctggttcaacctatgcaaaccaataaatgtaatccatcatataaacagaaccaaagacaaaaaccacatgattatctcaatagatgcagaaaaggcctttgacaaaattcaacagcccttcgtgctaaaaactctcaataaactgggtattgatgggacgtatccaaaaataataagaggtatttatgacaaacccacggccaatatcagactgaatgggcaaaaactggaagcattccctttgaaaactggcacaagacagggatgccctctcaccactcctattcaacatagtgttggaagttctggccagggcaatcaggcaggagaaggaaataaagggtattcaattaggaaaagaggaagtcaaattgtccctgtttgcagatgacatgattgtatatttagaaaaccccatcatctcagcccaaaatctccttaagctgataagcaacttcagcagtctcaggatacaaaatcagtgtgcaaaattcacaagcattcctatacaccaataacagacgaacagagagccaaatcatgagtgaactcccattcagaattgcttcaaagagaataaaatacctaggaatccaacttacaagggatgtgaaggacctcttcaagcagaactacaaaccactgctcaacgaaatcaaagaggacacaaacaaatggaagaacattctatgctcatggataggaagaatcaatattgtgaaaatggccatactgcccaaggtaatttatagattcaatgtcatccccatcaagctaccaatgactttcttcacagaattggaaaaaactactttaaagttcatatggaaccaaaaaagggcccacattgctaagacaatcctaagccaaaagaacaaagctggaggcatcacgctatgtgacctcaaactatactacaaggctacagtaaccaaaacagcatggtactggtaccaaaacagagatatagactaatggaacagaacagagcccccagaaataataccacacatctacaaccatctgatctttgacaaacctgacaaaaaaagaaacagggaaaggattccctatttaataaatggtgctgggaaaactggctagccatatgtagaaagctgaaactggatcccttccttacaccttatagaaaaattcattcaagatggattaaagacttaaatgttagacctaaaaccataaaaaccctagaagaaaacctaggcaataccattcaggacataggcatgggcaaggacttcatgactaaaacaccaaaaccaatggcaaccaaagcaaaaattacaaatgggatctaattaaactaaagagcttctgcacagcaaaagaaactaccatcagagtgaacaggcaacctacagaatgggagaaaatttttacaatctacccatctgacaaatggctaatatccagaatctacaaagaacttaaacaaatttacaagaaaaaaatcaaacaaacccatcaaaaagtgggagaaggatatgaacagacacttctcaaaagaagacatttatgcagccaaaagacacatgaaaaaatgctcatcatcactggccatcagagaaatgcaaattaaaaccacaatgagataccatctcatgccagttagaatggcaatcattaaaaagtcaggaaacaacaggtgctggagaggatgtggagacatgggaacacttttacactgttggtgggactgtaaactagttcaaccattggggaagacagtgtggcgattcctcaaggatctagaactagaaataccatttgacccagccatcccattactgggtatatacccaaaggattataaatcatgctactgtaaagacacatgcacacgtatgtttactgtagcactattcacagtagcaaagacttggaaccaacccaaatgtccatcaatgatagactggattaagaaaatgtggcacatatacaccatggaatactatgcagccataaaaaaggatgagttcatgtcctttgtagggacatggatgaaactggaaaccatcattctgagcaaactattgcaaggacagaaaaccaaacactgcatgttctcactcataggtgggaattggagaatgagaacacttggacacaagatggggaatatcatacactggagcctgtcatggggtggggggagggggggagatagcattaggagatatacctaatgtaaatgacaagttaatgggggcagcacaccaacatggcacatgtatacatatgtaacaaacctgcatgttgtgcacatgtaccctagaacttaaagtataataaaaaaaataataataaagtgtgagaatttggccaggcacagtggctcagccatgtaatcccaccactgtgggaggctgaggcagatggataacttgaggtcaggagtttcagacaagcctggttaacatggtgaaaccaagtctccactaaaaatacagaaattagcagggcatggtggcacttgcctgtaatcccagctacttgggaggctgagggaagagaatggcttgggccaggcgcagtggctcatgcttgtaatcccagcactttgggaggctggggcaggtggatcacttgaggccaggagtttgagaccagcctggccaacatggcgaaaccccatctctactaaaaatacaaaaattagccggatgttctggcgggcgcctgtaatctcagctacttgggtggctgaggcaggagaatcacttgaacccgggaggcagaggttgcagtgagtggagatcacaccattgcactccagcctgtgcgacaagagtgaaactccatctcagaaaaaaaaaaaaagaatcacttgaccttggagatggaggttctagttagctgagatcatgccactgcaccctagcctgggtgacagagtgagactctgtctcaaaaaaataaataaaataaagtgtgaggaaccagttagaatggcaatcattaaaaagtcaggaaacaacaggtgctggagaggatgtggagaaataggaacacttttacactgttggtgggactataaactagttcaaccattgtggaagtcagtgtggcgattcctcagggatctagaactagaaataccatttgacccagccatcccactactgggtatatacccaaaggactataaatcatgctgctataaagacacatgcacacgtatgtttactgcggcattattcacaataacaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacgtatgtaactaacctgcacaatgtgcacatgtaccctaaaacttaaagtataataaagtaaaaaataaaaaaataaaaaaaaatttaaaaaaagtaaataaagggtgaggattttagacttccatgatgttgtacactcatcatacactgcttcacacagggaaaaggacgttgtgttttctttgataaatagcagcttaatccactgttaattgttttaaagaatcacttttcatttttattttcttattgtattatatgcatcttatgttatatattgccttaatttttaagatgacagaataaatggatgaataaatgaatatcaaaaaaggcagtttaaagcaatgaaatggaatctatttaattggtctgggtataagaacaaatgagaaatatttggtccatatccaatggtttaatctccttaatttttatccagaactaaccccgtatctttggcattttgcagaaataaggattcactttaatatcactatgcaatatttctggatcataatccacctcagggaaggacagatttggttatggagacctcggaagtccaagtctctatgctaaatagacagcagaagaaccaatttaacagctttcaatatttctgtctgactccctgttggaattgcagttttgatgtggtgagtaggcgcatagaattaattggacattcttggaaatattttgtgattcaaatgaagaaataggagaatcctggatgtttcctggggtgttgggcttggggacctggactggggccaatcacattgtgagatgcccctcccagtcctgactttccctccttcttaatcaatatttcaatccttttaagccccaagatgaccaactgagttaaaaggcaggtaggtgagtgagaaaaagagaaaagacagccccactgcttgaccttgtgatgggcctgtagaatgagatcttagaaattcatttgcatatgaaccctaattctgtgtttcctttctcctacaaagcccagttgaccacagccatttttttgtgcctcactggctaacactcagaggatgccttactctagctcccccttactacaaagctccctaaaagtgaacatcacctctggactcactcattgccatggatttctttctcccctaggtttccgcagcctccttttccacttcggatttgaaaacatcttttgtttcgtctttttttccccttgttcaaaaaagaaatggatagagattcttccttgctttctaccttgcctccatttttttttttcttaatccagaattcttgggcctagcataggaaaaagtaatgctccaaatctgcacgtctcatagtggccctaattttatctgggtgctgtgcttgggatgagtctaggcacatcagttatggtgcctatgcctaaatgtcaccacttcaatctcctgtgtcccttgattgtgaaagtaagagcgtgtgtacaaggcactttttgtaagagcctgtgtaggaggcactttttgtattcctagaatctaaaatactggcatgtaaatgttaggaattcacacattgactttaagatctaccctttggttggatgtggtggctcatgcatgtaattccagcactttggaaggctgaggtaggaggactgcttgaggccaggagtttgaaaccagcctgggtaacaaagcgagacctggtctctacaaaaaaataattttaaaaagatctaccctttgtatggccggggggggggcggggggcggggggcggtggatccagcccattggtgtgtagttgataattaaattttgttcataccatagtgttaccggacgagggtgtccaggttcctggcgttttgaacaaagaattggacaaaacacagaaacaaagcaatgaagcaatgaagccacaaaagcagagatgtattgaaaacgaaaagtacactccacagggtgggagcagacccgagcagccactgaagggcccagttacagaatcttcgcgggtccaagtaccccctagaggttttccattggccacttggtgttcaccttatgtaaatgaagtggtggcttgcaatcagtctgattgcagagagcaaccagtcagaggctgagtgaagttacaaagttacactcccatgcaaacgtctgattggttgcaaaaagcaaccaatcagagatacttttaatttcccatctgccaatgcagaaaaatgggggtttgcaaagggagtagccacttgtccttttgtccttttgttacttaggcatggaaagttagggttttcctttcaatttcgttttaggaagtcagcgtgaaatggccttgggttccctgcctccagaccttattattctgcctcagttgcactcagggtccctgtcccatagttctgtgctgatatctgagatatcaagtgtgatattgactgaggcaaacgacaaattaccaattccaaaacgaatactaattgcataataacagtttccaagctgttagtctgctttcctaaaaaagctaatttaacacaagcacagaactggctcttgcccatgggttatattttcggttggcagattttgctttgcaaaaagattgggggaaatgaggactgttgtagaagaagcatacttggccttttgtgaagagggtacaaattgcatcaacctctcaaggcctgaaagtgtgaacacaaggacacttaataccttcaagagaggtcgattacctttcccagaggtaaaatgacctagtgctttggcttgagtgggatccttgaattttcagcccttcgaaggagagttttgtgcaggatggaggtgcttgagtgctgaggaactgaacctgggttggtacgcattgtccataggattcagggcccaggggagggcatggtcactaaatggctgatcctctctggaatgaaactttagaaagcaaaacgcaaaattttttgattactatagaatgctgaagttactggactcctcctgagattatgttcataactttttagctgaaactaacatctacaaagaccatctatcttggatgaacctattttctggtaaccagtgttaaatattttttaatcaaaaatttaaaacttgcattagaataatttctgattttcacctttttaaatagaattttttaaaatatattttttaaagatgaggtctcactacattgccctggctggtctggaacttgtgcactcaagcagtcctcccacctcagcctcccaaagtgctgggattacatgtgtgagccacagtgcccagtttgatttttgcctctgaaatatttgaagtatattttaaaatacatgctttttgtgggattacatttagaagacttctcttttttgaaacttagaaagagtggaaattattatccgcagcagtgtttttgaatattacctttgcctcatgccttaattcttgtggaacctggaagaagtagagatgcattaaaaatagtatatgtatcaaccaggcgccgtggctcattcctgtaatcccagcagtttgggacgccgaagtgggtggatcgcttgagcccaggaagtcgagaccagcttgggcaacatggtgaaaccccatctccactgaaaatacaaaaatcagccaggcatggtaacgcatgcctgtgatcccagctacttgggaggctgaggtgggaggatcccttgaacctgggaggtgcaggttgcagtgagctgagatcacgccactgcactccagccagggtgactgagtgagaacaggtctcaaaaaaaaaaaaaaaaaaagtatatatatgtgtctcttgaagaccccgtcagttatgggaaagggtattcactattctttcccagacagcctgagcatgaaaaaaaaaagttctgttagtgtgtgtcaaattgaatgttggtgttaattgcaggatttgtggggagtagttgtccagctttcaatctcaatatggcaaagccatgtgctcaactgtgaacacaggttagaagaggtcagaactcagtctgatggtgtcctgtggcttttatctttatagatcctgtagttctgttttgagggtacttataacattgaggaagctgatgtttaaaaagaacaggtgccaacattgggaaataagaaatgttggtttcaaaattttctggtgaggatggcagtgggcatgcgcaggtgcattcctagatgttccccactcccgccaggcgctgggggctctgggtagcaataacctcctctctgtgcagaagtcccacattacatgcaactgctttgttgacatttcgtatccacaactgtgaaggtcgcagagtgagatagtgggcaacacagcaaaaaaaatgcatgctttcctaagaaaacagagcctcactttacactgggaacacacaggtgctgtgaaactggactttgatttttcccgtgagaggaaattctgatggaactatggcact[132 bp omitted]cacctcctgggttcacgccattctcctgcctcagcctcctgagtaactgggactacaggtgcccgccaacacg[170 bp omitted]atgaaaagccttgcatttctagagattgctcaaaagcaaaggctgtattgagaagaacttaatgctttttaaaaagtgggcctggcctccttcagctctcccatttttctttttcttgttttctattctggcagttgcacgggaagaagacagcatgaacaatttactgcctgttccagtgaatgatgagtctggatcactgttcaggggactgtctctttgctttgagtcccaataaccccaaatattccctttctatttttaattagcaggaattcaagatctcttaaggatgaagagagcaacaaaatacattggaagttgtgattgtcagttttgagttggggaaggtgtaataatatgccttctgggctggggatgggggagaaaagggagaacagcctcattctggctttggtggagtttcctctcatgattcttctgaagcagcaggacctttgggccggaatggctcctattctcctgtgtcccccacaaaaagggagggcagtggacagaatttggagcatgtcgaatcaatgcttagctgttgccttcgcataaatactgagtagccacttaggaagcttcccctagagtccggagttgggcatgaatgttcctattagcacggatggggctctactctgtctgaaaacacagttctctcactaggaactcacccaccccatcatgcatatgtatgtggtcccaaagggtaagaatgaggatggggtgatggagagcagaggagaaaaagtatgggtcagtaaacacacaacgggtacctggagaacttctgtgaagtgcagggcctattcatgctgacgcagaaaggtcacctcatgaaaagaggactcctcaccattctgtttcaatgtcattcccttataaataccaatccatacattattaaccccatttgatacacacacagacacacacaaatggggcactgactttgtttatttggcatttggtgaactgctcttgatgttgtgctccgcacaattaaaatctgccagaaaaacactttggaaactgtcatgaagatagtaccttagagaagggggactacaaaatgacggctgatgacgggggctcattccaggccaactggggccaggccaaaggaaggcaagggcagacgaggcataggtggcatcggcagcctgagcagtggtggctccagaagagcccatctccaacagggctctggaacacggatgacatgatagggcccatccaagattatgcctacccagtggctcagggcgacagggccactgtcatgttatttctgaacattaattaatgtctcctgatatctcctctacttgactcacctatttttatttttgttttattttatttttttgatatatttaattttgttaactaaatcttaagtttaaatattgacaatgtcacacttgaattattgaatatatttaactttatgaaatatgttgctctaaatatgcatatttagtttaatgtgtattgttttatgtagataacttagagataattttgtatttgtcagtaatcctaaccacagaatgttacagttttcagtggcactaacactttcttctctaagaacattaaaataaatgagccaactggaataatgccaacacttctaattattgggccttaggagtaaatagatcaattgagaactatgtcttctaaaatagcaagcttagagatgtgctcggatgtgacaggtgcttgttcctgatgacaagggtgaatggccttgtaggactctttaaggagattgcacgttagcctaggttttgtaatagccagtctccaagatggtcctcagtgatccttgcctgttggtattcatgcccttgtgtagtttcctcccatattgaattagggttggccctctgtgaccaatagaatacagcagaagtgatggtgggccttccaacgctgtcatgaaatccactgatgcttctgctttggtgtcttggatcactcactctgggaaaagccagctacaatcctatgaggatcctgaataaccactgtaggaaggcccatatggagaagaaggaaggtgtgcaagcaacagccagcaccactttgccagtcacgtgaattagtcagcttggaagtgaatccttcagccccactcaagccttgagatgactgcagccctggccaaaatctgattgcatccttctcagagcaagaacttccaggccaaattcttccaaatttcctgacccatagaaaccatgagaaataataaatgattattgtttttctaacccactaagttttagaataacatgttactgatacagaaggtatggaagtgatgtgactcattcaaggaatttttgttttgttttgttttcgggttttttattttttattttattcatttatttattttttttgacagggtctcactcctgtcatccaggctgtagtgcagtggtgcaactatggctcactgcaaccttgactccctgggcccaggtaattctgctacttctgcctctcaggtagctgggaccacaggtgcacacaaccaccattggctaattttaaaattttttgtagagatggagtcttgctatgttgccagggctggtcttgacctcctgggctccagtgagcctcctgccatggcctcccaaagtgctgggattacagacatgagacactgcagcca[131 bp omitted]gcatggtaaaacgctgtttctactgaaaacacaaaaattagctaggcgtggtggtttgtacctatagtctcagctactcaggaggccaaggcaggagaatcgcttgaacccaggaggcagaggttgcagtgagccaagatcgaaccactgcactccagcctgagcgacagagcaagactcccgtctcaaaaaaaaagtatatatatatatatacacttatatatatatacttttatatatatacacatatatatatacttttatatatatacacttatatatatacttttatatatatacttatatatatacttttatatatacttatatatacttttatatgtatatacttatacttttatatgtatatttatacttttatatatatttatatatacttttatatatacttatatatgtattgtatacttttatatatatatttttaaagacatcagcaacattgtctgattttacttatttatttgttattatatattttttcatacagagacaggatcttgctgtgttgcccaggctgatcttgatcctggcctaaagttatcctcctgccttggcctcccaaagtgctagggcctcccaaagtgctagggcctcctgctaggcctcccaaagtgctagtggcagtgtgagccacttcccagctcataatctgattctaaagagacaaatgatttactaaaccgaaatttattttttaatttaatttattttattttttaattatactttaagttctagggtacatgtgcacaatgtgcaggtttgttacatatgtgtacatgtgccatgttggtgtgctgcacccattaactcgtcatttaccttaggtatatctcctaatgctatccctctcccctcccccaaccccacgacaggtcccggtgtgtgatgttccccaccctgtgtccaagtgttctcattgttcaattcccacctatgagtgagaacatgtggtgtttggttttctgtccttgtgatagtttgctcagaataatggtttctagcttcatccatgtccctacaaaggacatgaactcatccttttttatggctgcatagtattccatggtgtatatgtgccacattttctaaatccagtctatcattgatggacatttgggttggttccaagtctttgctattgtgaatagtgacgcaataaacatacgtgtgcatgtgtctttatagcagcatgatttataaccctttgggtatatacccagtaatgggatggctgggtcaaatggtatttctagttctagatccctgaggaatcgccatactgacttccacaatggttgaactagtttacagtcccaccaacagtgtaaaagtgttcctatttctccacatcctctccagcatctgctgtttcctgactttttaatgatcaccattctaactggtgtgagatggtatctcattgtggttttgatttgcatttctctgatggccagtgatgatgagcattttttcatgtgtctgttgagtgcataaatgtcttcttttgagaagtgtctgttcatatccttctcccactttttgatggggttgtttgattttttcttgtaaatttgtttaagttctttgtagattctggatatcagccctttgtcagatgggtagattgtaaaaattttctcccattctgtaggttgcctgttcactctgatggtagtttcttttgctgtgcagaagctctttagtttaattagatcttatttgtcaattttggctttggttgccattgcttttggtgttttagtcatgaagtccttgcccatgcctatgtcctgaatggtattgcctaggttttcttctagggtttttatggttttaggtctaacatttaagtctttaatccatcttgaatgaatttttctataaggtgtaaggaagggatccagtttcagctttctacatatggctagccagttttcccagcaccatttattaaatagggaatcctttccccgtttctttttttgtcaggtttgtcaaagatcagatggttgtagatgtgtggtattatttctgatggctctgttctgttccattggtctatatctctgttttggtaccagtaccatgctgttttggttactgtagccttgtggtatagcttgaagtcaggtaacgtgatgcctccagctttgttcttttggcttaggattgtcttggcaatgcgggctcttttttggttccatatgaactttaaagtagttttttccaattctgtgaagaaagtcattggtagcttgatggggatggcattgaatctataaattaccttgggcagtatggccattttcacaatattgattcttcctatccatgagcatggaatgttcttccatttgtttgtgtcctcttttattttgttgagcagtggtttacagttctccttgaagagttgacccacctatttttaaagcaaaccttcagtcagaggttttataaggtattggtttagtatatcgaacaattaatatcataagaaaaaaaaccccacaacatgtaactctatgccattgacattttaaactacactgggagaagctatttccttattggaaaaatattttaggaaagttaatgctgtatccctttcccttcagttctgttttggactatgcttattgctttgtctttctcctcccattgttaatattctttaagggtttttacccagctcctggatgtaagtctagtggacacattgcaatcagtacctgctgttaacgctatgcttggtaacaagatgaagaaatttcagtatcctgacagtggaccattggggtgtccttgagcagctgcctctggtgcctcacttcatagtgtcaccctggttgtggggatagttgagcgaggtataaggtgggccccatttgcagttatatggaggggaatggtccctccatttgggaagctaattttctcacattgttctcacaataacttcttattgcttattggaaaaatgagttaatactagagatacctactgataacttggtaactacttaaatgcaggcataaagcaatcatggcttgaagccagatactgcaaaaccaatcttttctcacatctgaattcctgtatattaattaatgagtttgcccaataggtaattagtcacaccttgttaactagatataactagatatactgatttaatttagaattttaattaacccacccttctcacatttaaatatttatatcttttgtaatatggaagtagtgctataaacagagttatctatgtaagatgtatgtaaagataactagatattactagaactagactgagtatgtgaagtcaggatgctgtcaaacaagttttcctcaaatttaacttcataattcttattttagaaaacttgctataatatagataatatgtggttcctagttaagtacttacttagagatattggaaataactagaaaaatacctgaatctaggatgttgaaaaacacattctttttacatccgaatttaatttcttttaacataaggtattggaaatatagataactagtggtagctatgtaattttaaattagagatacctagaattagctagaaagctacttaaagccataaagctgaaaaatacatgcttttcatctctaaaatattccttttttaatatttctttttggaatgtgcatttagtactcaaaatacctagcatactaaggtaagctttattttcatttttttgagacaggttctcactctgttacccaggctggagtgaaatggcaccatcatgattcactgtaacatcaaactccctggctcaagtgatccttctgcttcaggctcccaaggagctaggactacaggcatatgccaccatgcctggctaatttattttttattttttattttttatttttttaggtagagatgaggtctcactacgtttctcaggctgatctggaactcctggtctcaagccatcctcccaccttggcctcccaaagcacttgggttgacaggtatgagccactgcacccagcctctaaggtaagctttatataaagataactagatataacctagcctgggcaacatagggagaagctatttctaccaaagatttaaaaattagccacgtgtggtggtgtgagcctgtagtcccagctactcaggaggctgaggcgggacggtcaatagagcctgggaattagaggctgcagtgagcttgatgggctcagtgtactccagcctgggcgaccaagtgaggccatctcaaaggtaaataaataataaaaaatagatacaacctgaatgactagttgaaggcagaaagctaaataacacattttttttaatctaacttctcatcattgaaggaatatgttagtaatatagatgactaatgttacttatataactacttatagagaaataactggaaataactagaaaattaattgaagccaggatgttggaaaacatttttctcaagtgcaacttattatttcttcttgaagtaaagtactggaaaggtagataactagtgatacacagatatatcgaaataactggaaaactactagctgtccaaaaaagaacaacaacaacaaaaaactatacttatctgttctatattttttgaatgctattactataaataagtagtaatcaagaggcatttggtttactctggataactaaacatgagtggaataagtagttaaagctggagagctaaaaaacacaacacaaaattgtcaattgtaaattctccttatcattggaataattagttaatactgtaaatgttcagttggtacctttgtaattatttacctagaaataaccagaaatagccagaatagctagttgaaggcaggaagttgccagtcacgttcttttcaacactaaattctctgctgaagaaaagttgatcaatccaggaagttgaaacaatattcttctcaacactatagtcgtatctattgtggatataatgagttagtgctgtagataactatttgtacccaggacactaactacttggatataactattaatatggaaatgaagatgaggtaggaggccagagaagttattttccagtcacagggtcacgaccccactgatggaaacaggatcaggtcaaaacaggatgcagccgtcccagcctgttggctcgagcctgtaattcctgcactttgggaggccgaggtgggcggatcacttgaggccaggagttagagaccagcctggccaacatggtgaaaacccatctatactgaaaatataaaaattagctgggcgtggtgacgggtgcctgtaatcccagctacttgggaggctgaggcagaagaatagcttgaacccgggaggtggaggttgcagtgagccgagatcgcgccattgcactccagcctggggacacagtgagactcccttaaaaaaaaaaaagaaaaagaaaaacaacaacaaaaacccaaaaaaccaggatgcagggaagaagccagcgaaatccagcagatggcgacaaaagctacctctagttggcttcactgcccattagcatcaagacactcccagtgtaaagataatttacaactgccatagccaggggccatggcaatagccaggaagttaccttgaattttctggatactcctcactcgttttcttgaaagttctcaataacctgcctgttgattagcacataattaaaagtggtataaatacagctgccaacagcccatcagctgctggctctgggtgcactgcctatgggttagtgctgttctgcaagaagcaataccagttcaataaaagttgctctatctcactacctgctcatcctccatccgggcaaaatcccaatttggcagcttgcctgtcctacgtcaaagataaggaggtgagaaaatattctcataaataccttctttcttttctttctttttcttcttttttccttccttctttctcttctttttattttccttcctttttctttccttcttccttcttttctgtcctttctttctttctttcctttcttccctttcttccttcctttccttctttttctttctttttttgagacagcacctcgctgtgttgcctacactggagtgcagtgatgtttgaaagcacagtcttcacagactcaaattcttatttttttgtgaaataatgagtttatactacagatatctggtggtacctatgtcagtagtgaaatagatttaactagaaataaccagaaaaaaaatacgaagtcatgaagttgaaaaaatcatgatttaccactgcaacttcttatttcttattattataatgagttagtattatagatatctggtgatgtctacttcattacttacctcaaaataactggagataattaaaataagtattgtaatcctggaaggtgataaagaaagtcatgcagtactatgttctcgttccttgttggaattttgccttagaactatagctaagtattggtacctgagaaactagatatgtggagacatctgcagataactaaagtatctagtgtaagaagaaaaatattcttcttgattctaaaatgttatttcatgttggcatgatgtgttagtactgcaaataactggtggtacctagggaatgagtaaactggagatcacttgtgatatgtagaataattagtggaatccagagaattacctcatttcttgttggaatgatgggttagtattagaaataactaggtatcccttgtgaaatatacaattagaaataagtagagagaagcagaaaaacttgtagaaacccagaccctggaaacacattttttcaaatctaaattctttttacttgtggaataatgagtgaatggtatggttatgcagtggtacctaggtaattggacacaaccagagtaaacgtttgacagcaggaatgtaacaaagaattaaaaaagattatttatgaaaattaatattattaacataaaaataaattaataatgagcaataccataaaacaagaagtaagtatcacaaacaagaatacaaacattatttggaaatctgacttttatttttttgtaatagagtgttagtattattgataagtagtggtatctatttatttagaggtaacgacttaactcagtcaagtagacacataaaattaaccaccacagtatgtaactagtttagtagggatagttagagataacccggaaatctatttgaattcagaagttgaaaaaccattcgtcacacccctaattcttatctcatataggaatacatatttagtactatggttaactactggtcacaagattactagttaactacagagaactggttggagctagaaggtggaaaccacaatcctcacaactgggaattcttgattagagttccctctaattaactatactactgatacattatttcaaccagaattaagaatttcatgctgagtagattatggttccactttttagcttcagccagttatctgtagttaactagctaagctgttactactaattatccatagtaacaaatccttattcaaacaggagattaagatttagggtggtaatcccagcacttatggaggccaaggcaggtgaattgcttgagcccaggagttcgagaccagcattgggcaaacagtgagacctcgtctctataaaaaaattttttttaattcgccgggcatagtggctcctgcctgtcatcccagctcctcaagagactgaggtaggaggatggcttgagcatggggagtggaggtggcagtgagccgagatgttgccagtacactccagcctgggcaacggagtgagactctgtttcaaaaccaacaagcaaaccaagatttagggtggtatgaaacagtttttcaacttccagattcaagcagattttctggttatttctggctatccctagtaaagtagttacctcgctaccagtatttgtctatagcactaatacatgttgcaaatattaaatttagtgttgagaaaaaatgttttttcattttcctgccttcaaattatcgttctaggtatatctaattatctctaattaaataaataaatagatattattcccagaatcgagccgggtttggctgcgttttcttgtggcccaataaggacaaacagacaaattaggaaagaagggaatttattgctgtaaccggatacagggagaaggtcagagatattccaccagaccaactcaaagcgttaaaattttcttagtgcttacataggttggggttatgtgcctatgtgcagtatagcatttgcctaagtctgtaggtaactaattttgtttcaactaggtcagaggcaaaaaaatgcttgctaagtccgagtatgctgtgaggggcccagtgccttcaaggcatgtctattgtggtactggagtgattatttctgtcttatctcctttataacttggcccggagtactgtcttagactctccaataaatctgtttgaacagctgcctctgttaccttgactcgtctcagatttcatcgacccaagacagatcctggcactaggaatttaaggctgtctgcattattttgacttgctccaggttagggacaagcttatgcaaggctcctactgaccatgtgtttcatttctagctttgatgtctggacaccgatttccctagatttaactatttgctcaatgttaaggcagctctgtggaaatttatgtaactgaagtgttatgcaggcctgtgtgtgattgtcagggagaattggcctgccacaatagcactatgtatcaataatattacctcattgttattttaaaataaatgaaagaattaaaaacaagtctttactaacttcctggtgtcgtatattcattctggttatttctcttcacctttatttaactgattacctatgtaacactagatacctgcactactcactcattattccactatagtaagaaattagctttgacaaaaatgtgttttttcaattttgggctactatgtacttctctatttaactgtacttatgtctaggtactcccagatatctgtagtattaactccttattccaacaagaaattagaaagtagacttgagaaaatgtttctcatcttcctgcattcaaataattattccacttttcacaagctatcagtttgctttttccctagctaccatgacttacatgtagtattaacacattatgccaacaagaaacgtgatgtcagaattgggaagaatgctttttagcttcctggctcatactagtcattctagttacctccagttatccctagatacctacttttttaggtatcactacttttctataattctaaagcaacagtccaccaaagaataaggatctagtatataagactgtgcgtttcaggcaaactaaaatacacaaatgggacttcattaaactaaaaagcttctgcacagcaaaagaaataatcaacggactgaagagacaacctgttgaatgagagaaaatatgtgcaaactgttcatctgacaggggactaatatgcagaatatacagggaactcaaacaactcaagtggaaaaacccacaaataatctcatttaaaggtgggccaaaaacatgaatagacatttctcaaaagaagacatacaaaaggtatacgaaaaactgctcgaattcgttaatcatcagagaaatgcaaatgaaaaccacaatgagatattatcttatgccactcagaatagctattattaaaatgacaataaataacagatgttactgagtatgcagaaaaaaggtaagtcttatacagtgttggtgggcatgtaaactagtatagccactatgaatgacagtgtagtgatttctcaaaaaactaaaaatagaattaccattcgatccagcaatcccaacactgggtctacccaaagggaaagaaatcaatatatcaaagggataccttcattcgcatgtttattgcagcactattcacaatagcaaagatacggaagcaacttgtgctcatcaacagctgaatggataaagaaaatgtggtacatatattccacagtggaatagtattcaaccacaaaaaagaatgaaatcatgccatttgcagcaacatggatggaactgcaggtcattaccttaagggaaataaaccaggcacaaaaacacaagtatcacatgatctcacttatatgtgggagctaaaaaatgtggacacatggaggtagagagtggaaaaatagataacatagaatggaaagagtggagggaggggggatgatgaagagaagtcggtggaagggtgcaaacatacggtaagatacaaggaataaattcaatgtctgatagcagagtagggtgaatatacttaacaaaaatatacttgggtgagggataccctaataccctgacttgacactatgcattaaatacatgcaaccaaatttattctgtatcccctaaactggtacaagtacacatgtctcacgcctgtaatccaaggtactcaggaggctgaggcaggaggattggttgggtccaggagttcaagaccaacttgggcaacactgtctctagaaaagaaaaaaaaaaaactgtgcatttcaattttgaccacaaacgcatgttccaactatctttagttacctctagtaacctcgttgaataagtatcaccagctatccatagtattagctgattatgataacaagaaaccagaggttagagtggtaaatcatgatttttcagatttgtgccttcaaatattttttctttttttttttttttgagacggagtctcgctgtgtggcccaggctggagtgcagtggcacgatctgggctcactgcaagctcagcctcgcgggttcacgccattctcctgcctcagcctaccgagtagctgggactacaggtgcccgccaccacgcccggctaattttttgtatttttttttagtagagacggg[131 bp omitted]ttctacttaattcaaatttactagcgacctacataccaccagatatctgtagtacaaactcattttatcaaggaaagataagaatttcgtcttgtcgaggattgctttccaggttccaggcttctctgaggttttctagttatttctagttatctccagttcagtagttaccatgtactcctgcttatatagaactaactcattatgctaacaagaaataagaagttggttataggaagacgttgttctccactctctggctttatctgttattgacattttacaggtgtgacattattgagtcacagagacgttaagtaacctggtcaaagtcacccacttgggaaatgtccagcgctgggatttgaacctatcttgagtactatccgtgatacagaggatgtttgttatcatgctatatgctataattttcttttgtaattagtagctgtaattatcgctatttaactagtttcctgtgttcaagcagttatctctaggactaactgattccaacaacagacaaaaatgtagtgttgaggagaatggttaacttcctgaattcaaccacttttcttcagcatcctggtttaaacttcttattctagataatctcatttatccctcggttactaatgagggaggtaccactagatatctatggcactaattcgatattcaaacaagtgaaggaaattttgagctgaatgatactttatttctgtttatctctagttaactaattacaaaagaataataattatagcataatagcaaacgttattgagcacatcctctgtgtcagggatggtactgaggatgggttcaaatctcagctttggacattttccaagtgagtgactttaagcggggtacttaacatccaggtgactcaataacactacctataaaatgacaataatagcacatcaatatgtaccagtttgttaagaggattacatgtgttcatataaacaaatcacttagatcattgcctagaacacagtaagaaccaggtaagtgtgagctaccattagtatcatctcaattaatctccacaacagctccatgaggtaggtattattataacaggttttacagatgagaaaaatgaagcacagggagaaaaaaccactccccaggttagctaggtagcaaatgtcaagcaaagccatgatgcagatgccagcagtctaactccagggtccctgccctcataaatctaggacatcaaactcatcatttgggcctatttttgcttggatgatgctcaattacgtacaaaacatttgcaagaagtgactcaatttaactaaaaattttaagtgaatactaattgattggtggcccggtaggtaacactcaccgaaggggcacagaaatgactactgaagcttagaaagcactgaagcaagtcatggaaatctctcagacaccacacaactccaattctgacagatgtcctagctgggctaaggcacaccatgattaaaatcattgtaggtctctcacatagtaactgatcccaggccaaatttcatctcagagtgtctggccacgagaagggtgaggtctacagaaccctgcaagcggcagcctgaggaggagacgtcttggttaatgtcagggagagtctgtgggggtgaaattccttgacagcattttcagagtgaattgttcaaccaaccatcttgtagctggtttcctctctatcctcctggaacaggagaaaggagagacttacctgtctagcacagtgggcgaagtgagtgggtgtacctttatgggcctatgaaaatggtttattttattaaatgggtctgatggcaatggtgtttatcatggcaaaaaaaaaaaaaaggataaataatcccaatattcaggaaaccaactcattccaaggaacaattcttatttttaattaattaattaattaattaatttttatttatttatttttttagagccagggtttcattgagtcacccacgctggagtgcagtggtgtgatcatagctcactgcagcctccaatgcctggggttaagcgatccccccacctcagcctcctgaatagcttgcacgacagcgcatgacaccatgcccaactattttgttttttatttttttagagatgggtttttttctattttgctcaggttggtctcaaactcctggtctcaagcgattctcccgccgaagccacaggaggagctagtatttacaggcgcgcacaaccgagccc[135 bp omitted]tcctgaggcacacttcttaagggaaaaacatagaggtcccaatcggccctggctcttttttatttgacatttatcagtagggagcaaaaggtcagaatgatagttctagacaaagagtaggaaatgagaagcaggaggaggaggatgggtaacagaagtgggtgaggatggagggaagacgggagctaacccaagtccccagcgcctgcccagcacagtgaacactggcacttctgcagagggcttgcaacctaaggcgccagagcccagcatagcttagcagacattgcatgctccacagtcgcgtctagcgccaaaggaagggccacttgcagtgtaagccttctgggatgcactaaacaccaggcagggttctatgtgtactctgacgtggagtacctggagcttttgcaaggggcgtgttaggtttcttgcaacttgcacctgagcatccagagtgctctgcaaatcccagccccaaacttctgcttccacagatctcctggagagcgtggcgcactcaactttctggacattgctgcaaaaacctagcatgcagcctctgacttcatcatttcatcttaattacggtccgattcgcggactttgggtgggaacagaccagagctagagagactcatccattagttactaactacccagaggggagagcagtgctggcagtccaaattgcaaggtgcgctgccttcagcgtgcggcgtcttcgccctggagaagcattacgctggcccgcctgcctccagggccacacggaaacgtgttctgcaaactttctccaagggctcgggggctagattgtgtctcgctccgctgcctctccccctgcctcaatttcgactcctgccagacagctcagcccctccctctggcagtcaccccgcccggagtgggagtggtcaacgaagctgcaaaatggatcgcaagtccccacacacgtccgacccctccccgcgccctgaccacgaacgcatccctgacttaaccgccacactcgggccgtgagcgcctgccagcagggccttccgccacacacacacacacacacaccgcaagcagcggcgaccagggcaggagcccactccccgccacctgcaggcgtcggacccgaagtccacgagccggaactcagagcaggagccgaaggaccccagcgcagaatccgtggaggcgcacggcttcatccaccgcgctcccagatggggtcccagcccagatccggccacgaagacacaggcaaccccggcctgggtttcctgttccatgagctccaggaaggcgacagtcagtgcttgtctggggacccggaccggtgctttggggaactcccccggagggagagagtttggggaactctcccgagaagggaactttcccggagaggggggcgtggaccggacgctgctgcgcctcctctctcaggccgcggttctatgctgccctgtgcccgcgccaaacgccctgatctctctctgtctcctctctcaatctctctttgcctttcctcctttccagatgcgaaggctgtagggactttggtgactgaagctggaggagacgaggagaagaaaatacggtccaaacccgagcagggagctggagcagaagaagaaagtcacttctgtgcgggagctgccgaccccacgatcaaggataaccagaagcgcggcggtggcgaccaggagccctcgcagcagcagcctgaggcttccagcccaggactcctccgcggaggagccacaaccccaatattagcggcgtctcttcagccccagtgcgttcagcaggttgcacctgaaggagctagacagcattttcccacgctctgaatatctcgacgtgttcgctcggtaagcggcttgctctggagcttcccagttcccaggactctggggctcttccctggacgcctttggctctacccatgtctctttaccaggctccagtgccaagagctatttagggggctcaaggccactggctcagggccgctcttgagctgtgggatgcgggcgatagcaactgggcatcaaggtatttttcaagcagtatagatacgaatcaagttaaatatttgcattaaaattattaatcttcgggctggtgctgtggctcatgcctgtaatccgagcgctctgggagggcaagtcaggaggatcacttgagtccaggcgttcagggccaggctgaccaatatactgagacttcatctctacaaaaaattttgtaaaattagctgggcatattagcagcacgcacccgtaatccaaggtgctctggaggatcgcttgagcccagagttcaaggcttcagtgaactgtgatccggccactgccttccagcctgtgctacagagctagaccctgtctctaaaattagatacatagataaattacatgaatagatgacagatagatagagatagaaaaatcttgaatcctaagtgttttagccctctctgaaattctgcacacaaaggaaaacaatcccctacctaatgcaagcctggggctatttttaggtatcacagaaaaatgtgcaggagcagttgggaggctagacattttcaaactggtatgaaatgttcataggtgtatttcgtttcatccacaattccaaatactgaatttttgtagttttctttcccagaaagcagcttgcaatctgcatggatgtgagtgaagccgaagtggaagccagtaagcctgatgaaagcaattggtcagagtagccactctctgaaacctgcctcagtccttgaatacctttgtcctacacattctccaattggcctgtttttgttgccttttctatgtttgccaagtgagttttgaactttagcgggggaataatgggatacataaaccttagcctatggaaatttcccattaccagagggaatatgctttctaatgcgaaacagaactaaactgttacttctatttcctgtacaaggttaagtgtaaataaagttccattccttctaacaatggtatcctttagagaacacttctgtgtggagttatgttgggactgagtctgacttgaggagtttgcaaattaatgcaccaaggacccatattgtgagaaggttcaactgtatttaaaatatttaaaccaggctatgttcttagctaaatgaccaaatttataaatattcaggcattgggataagggaataagttacatacagaaagaacacattatatgagtaattaatgtatgtttagtttcactgagacttatggggaggacatagcttaaaagtccaagtgcctggtagtcctgctgttgtttttaagggtctgatgaagccatgtagaaagtggcagcccgcaattttgattttctccaatacttttatttgtaagccggaatacactgctaatatacttgcattacactgggggtgtgggggggcaggtttgcaaacaggaaatttgtttaaaaattggaataaaaaagaacaattttgaaaaagttttcacttaactaagaagggtgaaaaggttaaagaaaaattgcatacactcaaatatataccttgaaggtatggcacaaatggagctctatgagggaatattctctttaggaatttctgacaactaagaagttttttttatgttactgttttaaactggtgggttttatgtaatttgtttggtggtggggtggggcacgctcaatttagaccaggttcttacctgtgctaatttgaaatggtttttcattttcccaggcagtggtgattaatttgtaagtcatgagatcaagaaattactaagattacttcagtattattgactgagtatattttcaaaacaaagagaaaatccaggattaggttatgagcagtgctgtgcagttcatgtgagtgcagtgatgggccccccatgactaagccttttttttcagaccatctttttcactctcaagagttttcagaggatgaagtctggcccagtggctcacgcctgtaatcccagcaatttgggaggccaaggcaggcagatcacgcgaggtcaggagttcgagaccagcctggccaacatggtgaaaccccatggtgaaaatacaaaaattacctggacttggtagcgcaccactgtagtcccacctactaggtgtagcatgaggcaggtggatcgcttgaacctgacaggcagaggttgcagt[132 bp omitted]gatccagcctgctcctattgatgtagttacttcagactgaagatgggcttttcaaacggggttgcagtgtgtaaagatccggccattgcactccagcctgggtgacagagtgagactccgtctcaaaaaccacaacaaaaaagaaactttagaaagcaaaacccccaatttttttgattactatagaatgcagaagctcctggactcttcccgagattgtgttcataacttttcagctgaaactaacatctgtgaagaccatctatcttgggtgaacctattttctggtaaccagtgttaaatattttttaataaataaaaattttaaacttgtattagaacagttaatttctcgtctttgccttttttccttttttaatatgtttttaaaatcccttttgagagatgagatctgaatatgttgcccagactggttttgaactcctgagctcaaacaatcctctcacctcggtttccagaagtgccgggattacaggcctgggcgatcacacctggcctggttgttgcctttgcaatatttgaagtacattttaaaatacatgcgttttgtgggattacttttaaaagaactctctgttttgaaatttagattgagtggaaactattatctaaagcattattttttactatttcctctgccccacgccttagttcttctggaactttgaagaactagagagacattaaaaatagtacatatgtcggtgagttgccgtggctccgttcaagcgatgccggggggtggattgcatgagcccaggagtttgagacaagcctgggcaacatggtgaaaccacagctccactaaaagtacaaaaatcagctgggcatggtggtgcatgcctgtagtcccagctacaggggaggctgaggtgggaggatcccttgagcctaggaagtggaagttgcagtgaggtgagaccgggccactgcactccagcctggacgacggagtgagaccctgagtcaaaaacaaaaacaaaacagacaaacaagtaaatacatgtctcttgaagactccatcacttatgggaaatggtattcactattcttttcctgagcatgaaaaaaatgttctgttagtgtgtgtcaaattgaatgttagtgtttactgcatgatttgtgtggagtatttctttggcttccaattgcaatatggcaaaaccatgtgctcaactgggacaaaggctagaagaggtcagaactcggtctgatggtgtcctgtggcttttatttctatagattctgtagttctgtttagagggtacctacagcattgaggaagctgatgtttaaaaa[185 bp omitted]ggtggcgggcgcctgtagtcccagttacacgggaggctgaggcaggagaatggtgtgaacccgggaggcggagcctgcagtgagcccagatcgcaccactgcactcccgcctgggtgacagagtgagactccgactcaaaaaaaaaaaaaaaggaaatgttggtttcaaaattatctggtgaggatggcagtgggcatacacaggcgcattcctagatgttccccaattcagccaggcgctgggggctctgggtatcaataatctcctctctgtgcagaagtcccacattacatgcaactgctttgctgacatttcatatccacaactgtgaagttcgcagagtgagatagtggacaacatagcaaaaaatgcatgctttcctaagaaaacagagcctcgctttacactgggaacacatacgtgctgtgaaactggactttgatttaacccctgcgagaggaaattctgatggaactgtggcacttatcttagtaatcacttcatagtgcagccttggtgctcacaattaaccacttttaatagccaacgagaagtcttgcattgctagagattgctcataagcaaaggctgtattgagaagaacttaatgtttctttaaaaatgggcctggcttccttcaccctcccatttttgtttttgttgttttctactctggtagttgcacaggaagaagacaccatgatcaaatgactgcctattccagtgaatgatgagtctagattactgctcaggggaccatctccttgattccagtgccaataaccccaaagatgccctttctatttttaattagcaggaattcgagatctcttaaggatgaagagagcaacaaaatacattggacagtgtgattgtccgttttgaattggggaaggtgcaataatatgccttctgggctggggatgggggagaaaagggagaacagcttcattctggctttggtggagtctcatctcatgattcttctgaagcagcaggacctttgggccagaatgactcctattcccctgtgtcccccacaaaaagggagggcggtggacagaatttggagcatgtcgaatcaatgcttagctgttgccttcccataaatactgagtagccgcttaggaagcttcccctagagtccggagttgggcatggatgtccctattaacattgatgggtccctattctgtctgaaaaaaagggccaaactagttctaaattcactaaaagtcacccgcaccagctctgcagctcctttccatcactgccctcacacaaactgcagagcgaggctcataacctcatcctggattttgttttcgttttggaaaattctctcttaataaaacttaagtaatcttagaaatcttttgatcccatgacctacaaattaatcatcactgcctgggaaaatgaaaacgtatttcaaataagcacaggtaagaatctggtttaaattgagcgtgctccccatcaccaaacaaatttcataaaacccacctctttagacagtcccatcaaaataattccttagttgttagaaattcctcaagagaatattcactcataaagttcaatttgtgccatttcttcaaggtatatatgtaagtgtatgccattcttctttaaccttttcacccttcttaggtgactggaaccttattcaaaattgttcttgtttgttccaatttttaggcaaatttccagtttgcaaacctgtctccccccgccccccactgtaatgtgcgtatattagcagtgttttcaggctgacacatcgaagtattccagaaaattacaatttcaggtagccactttctacatgtcttcatcagacacttcgaaaaaatagcaggaccaccaggcacttggacttttaagctatctcctccccatcagtctcagtgaaactaaacgtacttaattactcatatagtgtgttgtctgtgtgtgtgacttagtcccttaacccaatgcccgaatatttataaactcactcactgagctaagaacctaacttggtttaaatattttaaatacagttgaagcttctcacatcgtagctctttggtgcattaatttgcatacttctaagtcagactcagtcccaagatacctccacacagaagtagtctctaaaggatactattgttagaaggaaccgaactttgtttattcttaattttgtacaggaaatagaagtagcagtttggtatgtatagttttatttttccattagaaagcatattccctctggtaatgtgtaatttccataagctggggtttccttatcccatttttcaccctctaaagttcagaactcactttgcaaacatagaaaaggcaacaaaaataggccaacttgagaatgtgtaggacaaaggtatcaaaggactgaagcaggtttcagagtggctactctgaccagttgctttcatcaggcttactggcttccacttcgacttcacttacatccatgcatattgtaagctcctttctggggcagaaaaccacaaacgttcagtatttaaactttttcagaattgtggatgaaatgaaatacactgatgaacgtttcataccggtttgaaaatgtctatcctctcaaccgctccagcatatttttctgtgatacctagccccaggcttgcattagggatggctgtccttggtgtgcagaatttaaaagagcactaaaacactcaggattcaagatatctctttctatttaactgtccatctatctatttaattttagagatagggtctagctctgttgaccaggctggaggaggggtgacacaatcatggttcactgaacccacgaacacctgggctcaagcgatcctacggagtagctgagactacaggtgtgtgccaccatgccggtctaat[132 bp omitted]cctcagcctcccgagcggctgggactacaggcgcccgccaccacgcccggctaattttttaaaatatttttagtagagacggg[136 bp omitted]gtatcattatattgctcaggctggtcttgaacgcctggactcaaatgatcctcccgccttggcctcccagagtgctaggattacaggcatgagccaccgaaccagcccgaagattaacaaatgttaaggcattattttaaaaatcaagaccaatgaaaaaaatccacagtaaccaaattgttaaaatgttcaataaaggcaagatccaaccgtgtaggactcactctcctcaccctgatgtccatcgcaattccaacaaaacatttccaaaacaggagtctggccaaagtttcctggcttgattcgtttctataatgcgtgaaaaaataccttaatgcccagtaggcatcgcccccaccccacagctcaagagtgacctactccagtggccttgagccccatatgtagcttttgactctggaggggagggagcgagactggggcagggccaaaggcgtcccgggaagagccctagcgtcctggataattgcgcacctctagagcaagccgcttacctagcaaacacgtcgggatactgagagcatcggaaaatgctgtctagctccttcaggtgcaacccactgaatgcactgggggagaagagatgctgctgatcttctggctgcagctccgaggaagaagagtcctgggcggactcctcaggctgctgctgccagggctcctggtatccaccgccgcccttctggttctcgtcgaacatggggtccgcagctcccgcgcagacgtgactttcttctgcttctgctccctgctcgggttcggactcttcttcttatcctctcctcccacttcaatcaccgaaggccctatagccctatagccttcgcatctggaaaggaggagagggaaaggaagggagggagggagggagggagggagagagagagagagagagagagagagagagagagagagagagagagagagaggcgcacagggcagcctagactcgcggcctgagaaaggtggcacagcagcttcccgcccacgcgcctctctccgggaaagttcctttcctagagttgaacaaatcaccggtccgggtccccagccaggcactgaccgtcgccttcctggagctcatggaacacgaagcccaggcagaggtagccggtgtcttcgtggctagatctgggctgggacgcgatctgagagcgcggtggatgaagccctgcgcctccgcggattctgcgctggggtcctctagctcctggttcgagttccggcgcgtggacttcgggtccaacgcctgcacgtggcggggagccggctgctgccctggtcgcctccgctggcggggtatgtgtgtgtgtgtgtgtgtgtgtgtgtgtgtgtgtgtgtgtggcggacggaaggtcctgctggcacgcgctcacggcaggaaggtggcggtaaagtcaggggcgagctcctggtcagggcgcggggagggggtcgggcgtgcagggaacccgcgctccagtttgcggcttggttgaccactcccaacccgggtggggtgactgccaggaggaaggggccaagctgcctggcgccaacagattggggcaggggaaggggcggaggagctagacccaatagagaaagttaacagaacatgtctctgtccagccctccaggcacgcgggcttgcagaatgcttctccagggcgaaggcgctgcaagctgaaggcagtgcaccttgcggcgtgggttcctggcaccacgctgccctctgactagttggtgactaatgcatgagactctctggttgtgttccgttcgcactcaaagtcctcgaatcggaccgtaattaagatgaaatgatgaggtcggaggctgcatgctaggtttttgcagcaacgtccagaaaattgagcacgcaacgctctccaagggggtctggggaaccctgagtttgggcctgggtttggcagaccgctccggatgctcaaatgcaagctgcaagaaacctaacacgccccttgctaactaattactccacctcagagtacaagcgtagaaccctgttcggtgtttagtgcatctaagaagggttacactgcaagtgaatcttcctttggctctagacgcgactgcggagcatgaaatgtctgctaagctatattctgctccagagcctcaggttgcaggccctctgcagaagcgggagtgtttcgtgtgctgggcgggcgctgtggacttggcttagttcccgccttcccttgctcgtcatcaccttctcttacccaccctcctcgtcctcctcctgctttccctttcctactctttgtctagaattatctttcagacctcttgctccctactgataaatgtcaaataaaaaagaggcagggtagattgggagctctatgtttctcccttcaagaagtgtgcctcagaacgatgaaggctgtgggttacagtgatctatggtcgccccactgcaatcctgccactgcactccagcctgggagaaaaagagagaccctgtaccttaaaaaagaaaatggttcctcgggatgatgctgggcccggtggtgcgtgcctgtaatcctagctactccaggaggctgaggcgggaggatcgctttagcccaggagtttgagaccagcctgagtaacacagcaagacccccatctctcaaaaaataaaaaacaaaaatagcgggacgtggtggcacgcacctgaagtctaagctactcacctagctgaagcgggaaaatcgcttgaacctaagcgttggagactgtagtgagctatttttaccagcggaggctgttcagtttgttggcgttttgaacaaagaattggacaaaactcgcaaggaaacaatgaagcaacaaaagcagagatttatggaaaacgaaagttcactccacagggtgggagcaggcctgagcagccactcaagggccccgatacagaatcttctcgggtccaaataccccctagaagtttcccattggctactaggtgttcaccttaggtaaatgaagtgatgactggcaatcagtctaaatggttgtggaaagcaaccaatcagaggctgaagtgaagtcacaaagttccattcctctgcaaaggtctgattggttccaaaaagcaaccaatcagaggtacttttaatttcccgtctgcccagcagataaggtgggggtttgcaaagggagtagccacaggtgcttttgttacttaggcgtgggaagttagggctttcctttcaatttagttctaggatgtcagcctgaaacggcattaggttcactgcttccagaccctattctcctgcctcactatgatcacaccactgcactccatcctgaactacagactgagaccctagctgtaaaacataaaacaaaataaaaaataagaatcaggccttggaatgagttggtttcctgaatattgggattatttagccaattttggccttcagaaccaccactgtcatcaggcctatttaataaattaaacaattttcataggcccctaaaaagaactgggacccccactcactttgcccactctgcctgacagataaatctctcctctctcccattcctggatggtagataggaagccagctacagaatggttggttgaccaattcactctgaaaaagctgtcaaggaatttcacccacagactgtccctgacattaaccaagacgtctcctcctcaggctggatcttgcagggtccggcagacctcacccttctcatggccagacacactttgatgaattttcgcctgggatcagttactatgtgagagacctacaatggttttaatcatggtgtgtattagcccaactcggatatctgtcagaattggagttgtgtggtgtctcacagctgagatttccatgacttgcttcagtgctttctaaatttcagtagtcatttctgtgtccctttggtgagtgttacctaccagagcaccaatcaaagtagtatttactttaaaatttttagttaaattgattcacttcttgtaaatgctacgtactgaattgagcctcatcccaataagcataggcacaaatgatgggtttgatgtcctagatttatgagggcagggaccctggagccagactgctggcatctgcatgatggcattgcttgacatttgctagctagctcacctgatgagttgccttttctctctgtgcttcaattttctcatctgtaaaatgaggtgataataatatctacctcatggagcagttgtggagattaattgagatgataccaatggtagctcacacttacctggttcttactgtgttctaggcaatgatctaaatgatttgtttatatgaacacatgtaatcctcttaacaaacctatatacacattgatgtgctattatacgtcattttacaggtggtgttattgagtcaccaaggtgttaagtatcctgctcaaattcactcacttgggaaatgtccaaagctgagatttgaacccatcctctgagtattattcctaacagagaggatgtgcccaatgacatttgcaattatggtataattattattcttttgtaattagttaactagaaataagcagaaataaaagtatcattcatctcaaaatttctttcacttgtttgaatatcgaattagtgccatagatatctactggtacctccctcattagtaaccgagggataagtgaggatatctagaataacaagtttaaaccaggatgctgaagaaaagtggctgaactcagaaagttaaccattctcctcaacactgcatttttgtttatcgttggaatcagttagtcctgtagataagtggttgcacacatgaaaatagttaaacaaatcccagctctggacatttccccagtgggtgactttgagcaggttacataacatctgtgtgactcaataacatcacacctgtaacatgtcaataacagataaagccagagagtgaagaacatcttcttcctataaccaacttcttatttcttgttagcataatgagttagttctatataacaaggggcacataggtaactactgaactggagataatgagagataactggaaaacagagaagcctggaacctagaaagcaattttcaacaagacaaaattcttatgtttcattgataaaatcaatttgtactatagacatcaagtggtaggtaggtcaatagcaaatttaagtaaagtagaaataattagaaaataacttgaaggtatgaatctgaaaaatcaggatttaccactctaacttctgatttcttgttataataatgagctaatactatagataactggtgatacgtattgatgtggtttggctctgtgtccccacccaaatctcatcttgaattgtactcccataatacccacatgttgtgggaggtacccggtgggagataatttgaatcatgggggcggtttcccccatactgttctcgtggtagtgaataagtctcatgagatctggtggttttatcaggggattctgcttttgcatcttcctcattttctcttgcggctgccatgtaagaagtgccttttgcctcccaccatgattctgaggcctccccaaacacgtggaactgtaagtccaattaaatctctttttcttcccagtctcaggtatgtcttcacctgcagcatgaaaatggactaatacacctctttaatgaggttacaagaggtaactaaagataattaggacatgcatttgacgtcgaaattgaaatgcacagtcttaaaaaattgtttttctggctgggcatggcaacttatgcctgtaatcccagcactttaggaggccgaggtgggcgggtcacctgaggttaggagtttgagactagcctggccaacatggtgaaaccctgtctctactaaaaatataaaaattagttgggcatggtattgggtgcctgtaatcccagttactcgggaggctgagacaggagaattgctcgaacctgggaggtggaggttgcagtgagccatgattgtgccattgccctccagcctgggcaatggagcgagactctgtctcaaaaacaaacaaaaaaattgtgtttcttttctagagacagggtttcactatgttacccaagctggtcttgaattcctgggcccaagcaatcctcctgcctcagcctcctgagtaacttggattacagatgtgagacatttgtatttgtacaaacttatgggatacatgaggaatttagttgcatgaatttaatgcatagtgtcaagtcagggtattagggtatccatcatccaagtacatttttgttaagtatactcatcctactctgctatcaaacattgaatttattccttctatcttactgtatgtttgcacccttccacccacttctcttcatcatcccccctccctctgctctttctattctatgttatctatttttgccctctctgcttccatgtgtccacatttttaagctcccacatataagtgagaacatgtgatacttctctttttgtgcctggtttacttcccttaaggtaatgacctgcagttccatccatgttgctgcaaatggcattatttcattcttttttatggctgaatattatctcttcctgagaggccttagactgagccaatatttaacgctggctacaagaaaataggttcacccaagatagatggtctttgtagatgttagtttcagctgcaaaattatgaaccagtctcgggaggagtccagtagcttcagcattcaaggccccagatacagaatcttctcaggtccaagtaccccctagaggtttcccactggccacttggtgtccacctcatgtaaatgaagtggtagcctgcaatcattctgattggttgcttgtcacaaccaatcagaggctgaaataaagttacaaggttcacagccaatcagaggtgaatgtgaagttacaaagttgcacttctatgcaaagtaagacttggcccacaatcagtttgattggttgcagacagcaatcaatcagaggctgaggtgaagttacaaagttacactcctacgcaaaggtccaaatggttgcaaaaagtaccagtcacaggtactttcaacttcccattggccctgcagaaaaagtgggttttgcaaagggtgtagcctctggtccttttgttatttaggcatggaaagttagggtttttgtttcaatttagttctaggaagtaagcgtggaacggccttaggttttctgcctccagaccttattttcctgcttcagaagggctgaaaactcaaggatcccacccaagcagaagcactgggtcattttacctttaggaaaattaatcaacctcccttgaaggtattcggtatccttgtgtccacgctttctggccttgagaggttgatgcactttgtaccctcttcacaaatggccaagtatgcttcctctgcaacagccctcatttcccccaatatttttgcaaagccaagtcagccaaccaacagtacaacccgtgagcaaaagccagttctgtgcttgtgttaaattaacgtttttaggaaagcaggctaacagcttggaaactgtcatgatgcaatgcaattggtatttgttttgaaatatgtaacttatggtttgcctcaataaatatcacacttgctccttctcagatatcagcacagaactatgggacagggaccctcacttcagtggtataaacaaaatttaattttcaactacacaccaatgggctggatccccccatacaaagggtagatcttttttttttttttttttgagacggagtctcgctctgtggcccaggctggagtgcagtggcatgatctcggctcactgcaagctccacctcccgggttcacgccattctcctgcctcagcctctctagtagctgggactacaggcgcccgccac[175 bp omitted]agagcatgggtttcgctttgttacccaggctggtctctaactcctggcctcgaacaatactcctacctcagcctcccaaagtgctggaattacaggcatgagccaccacgtccagatgaagggtagatcttaaggtgaatgtgtgaattcctaacatttacatgccagtgttttagattctgggaatacaaaagatacctcgtacacacattcttgattttacaatcaagggacacgagagattgaagtggtgacattcaggcatagacaccataactgatttacctagactcatcccaagcacagcatccagactaaattagagccactatgagaagtgcaggtttggagcgtgactttttcctctgataggcccaagaattttggtttaagaaaaaaaaaaaaaatagaggcagggcagaaggcaaggaagaatctctgtccatttcatttttgaacgaggggcaaaaagatgaaacaaaagatgttttaaaatcagaagtggagaagaaggctgtggaaacctagtggagagaggaatccatgggaatgacagagcccagagctgttgttcacttttagggagctgtgtggtaacggggagctgggagtagggcatccactcagtgttagccagtggggcacaaaaagatggttgtggtcaactgggttttataggagaaaggaaaacagaactcaggttcatatacaaatggatttctaatgtctccttccacagcccccattacaaggtcaagcagtagggcctgtcttttctctttttctctctcacctacctgccttttaactcagttggtcttcttaaggggcttaccaggattgaaacattgattaagaaggagtgaaagtcaggactgggaggggcatctcacaatgtgactggccctggcgcaggtccctaagcctaacaccccaggaaacatccaggattgtcctatttcttcatttgatcagaagatatttccaagaatgtccaattaattctatgcgcctactcaccacatcaaaactgcaattccaacagggagtcagaaaaattttgaaaggtgttaacttggttcttccgctgtttgtttagcatagagacttggacttctgaggtatccataaccaaatctgtccttccccgagatggattatgatccagagatattgcatagtgatatattaagctgaatctttaattcagcaaaccaagatagggggttagttctggataaaaattaagcagattaaaccattgggtatggaccaaatatttctcgtttgttcttttacctggaccaattagatggattcctttttcattgctacaaactgtcatttttgctattcatttattcatccatttattccctgttgtcttagaatagataggcagatacagagaattacagtttaccaggagtagaagcccaccagcagaaacccacagttggagccaatatgagtaggaaaactttcaactgtcattgttgaatttctagaagctcagcatggactatctggagagttaaaactccaagggtggtggcagccttaaggggactgcacattttcatgagttttatctccagaagccccaccaagttgtcactgggaagggagggcatgggaatcccttcctgcttccagcaggtggacaagaaaagcaatcattttgaaatatgcccagagctctttgttttccttaaccaaggactactctgggaagaaactattttatcagagcctaaccaacttgggtttccccagactgaccaaccacggcgaaaggaagtactcaactccagccccgtctagtctgccatctaacccaaaaggatgggtggggacgctgagaagcacttgtaaaggtcacagcccagggacacaggctcagtgaacaactgagatctaatcatggcatgatagaatgcttgccctcctcccaaccttatcaccacatcagtaagaatcctgtataataactgcagattataggtgaattacagctgaaaagactgcaagcctcacattatatgtaagaaggagcctctagaaaaactcaaagacaacaaaggaccctaccaagacaaggacccttcaacaaactttaacttctgacacctaaagttacagccaacagtaaacagcctaatcttcctagccagagaaccataaaacctcacacaaaagtactatctacctgagttttttttttttcctttttcctttttttgtagtgacagggtctcactgtattattgcccaggctggtctcgaattcctggcctcaagtgatcctctgactcagccttccaaagtgctgggattacaggcatgagccaccacacccagcctacctcagttctttctacccagtacatcaggtatgattttcaacaaaaacgtataagactgctaaaagtcaaaaaacacattctgggaccaagtgcagtggcccatacctgtaatcccagcacttcagaggccaaggtgaggggatcacttgagcccagaagttctagatcagcctgggcaacatagagagaccccatctctacaaaaaataagaaaaagtagccagcatggtggcgtgtgcctgtagtcctacttactaggggactggggtgggaggattgcttgagtactgaaggttgaggctgcagtgagccatgattgtgccgctgcactccagcttgggcaacagagtgagaccctatctgaaaaaaaatcacattatgaagagacaaagcaagcatcagaacccaattaaaatacagcagagattttagaatgattagattgggaatttacaataactatgataattatgctaagggctctattggaaaaagtagacaacatgcaaaaacagatgagtaatgtatagaaagataaaaactctaagaaaaaaataaaaaaacaaatgctaggtatcacaaacatagtaatagaaatgaagaatgtcttgaagggctcatcaacagactagagaagacagcaaagaatcagtaaactagaagatatgacaatggaaacttcccaatatgggctggacatggtggctcacacctgtaagtccagcactttagggggccaaaatgggagaattgcttgaggcaagtgtgagaccagcctgggcaacatagcaagacctcatctctgaaaaaaaattatccagacgtggtgcctgaggcaggaggattgcatgagccccagggttggaggcttcagtgagctatgatcatgccactgcactccagcctgggtgacagactgagaccctgtctcaaaaaaataaataaataaataaacgaaagaaagaaaagaggagagatgagaagagatgaaaataaaacttcccaataggacaataaaaattttctaaactgaaaagcaaagagaaaaaaataatgaaacaaaaaccaaacagaatatcaaggaactgtggacaattacaaaggtgtaacctatgcataatgggagaagagagaaaaaattgaaggaataattgatggaataatggcagagaattttccaaagttaatggcagagaccaaaccacagatcccagaaggtcaaagaacatcaaacgggataaataccaagaaatctacatttaaacttactatattcaaactatagaaaatcaaacacaaagagaaactcttgaaaggcggtgaaaacaatggcttacctatcgaagagcaagaagaggtgttcaaagaaaaacaccaacaacctagatttcttcatccggtgaagttaccctttgagaaaaggagaaataaagactttttcagagaaacaaaattgagagaaattgtcaccagtataactgccttgcaataaatgttaaatgtttttcaaagaaaagaaaaatgatagaggtcagaaactctaatttacattggaggccagttcttattggtaaaatattttaggaaacttaatgctgtacccccttgccttccgttctgttttggattatgcttattgctttgtttctctctcctcccatttttaatattctttaagggtttttccagctcctggatatgagtctagtgaacaaactgcactaagtatctgctgttaacgctatgcttggtaataggatgaagaaatgtcagtatcctgacagtggaccattggggtgtctagctgcctctactccctcttcattaggaatagtgtcaccctggtagtggtgatagttgagcaaggtatatggtgggccccatttagagttatagggtgggaaggccccccatttgaaaaggccatcttcagtctgaggtgactacatcaataggagcaggttggatttttaatcaggtttcctcaaggatgtctaaggggtcattcatcctctgaaaactttttttttttttgagacagggtcttgctctgttacccagactggaatgcagtggcacaatctcggctcacctctcgggtccaggcgatcctcctgcctcagcctttgtagtagctggggctacagtggtatcccagcacgtctggctaatttttgtatttttaccatgaggtttcaccatgttggccaggctggtctcaaattcctggccttaagtgatccaccggcctctgcctcccaaagtgttggaattacaggcatgagccactgggcccagacttcatcctctgaaaaatcttgaaactgaaaaggatggtctgaaaaaaaagcttggtcatggggggcccagagagtttgtggcttgtctagctgggacagaatagtcctgatgccctggatattgccttgatattttagcctgcagagttaaggaaaatttggccaaactaggtctaaattcactaaaagtcaccagcactagttctgcagctcctttccatcactgcactcacacaaactgcagagcgaggctcataatctcatcctgggttttcttcttgttttgaaaaaatactcttaataaaacttaagttatcttagtgactttttgatcccatgacctacaaattcatcatcactgcctgggaaaatgaaaaactatttcaaattagcataggttacattcgggtctaaattgagcgtgccctaccccaccaaaaaatttcataaaacctaccagtttaaaacagtaacaggccgggcacggtggctcacacctgtaatcccagcactttgggaggacgaggcgggtggatcatgatgtcaggagatcgagaccatcctggataacacggtgaaaacccatctctactaaaaatacaaaaaattcactaggcgtggtgatgggcgcctgtagtcccagctactcgggaggctgaggcaggagaatggcaggaacccggaaggtggagcttgcagtgagcccagattgcgccactgcactacagcctgggcgacagagcgagactccatctcaaaaacaaaaacaaaaacaaaacaaagcaaaaaaaccagtaataccaaaaactccttagttgttagaaattcctcaagagaatattccctcacaaagctcaatttgtgccgtatcttccaggtatatatttgagtgtatgcaattcttttttaaccttttcagctttctaaggtgagtggaaccttattcaaaatttttcttgtttattccaatttttaggcaaatttctagtttgaaaacctgcccccccacacccccactgtactgcaagtatattagcagagcattcacgcttacaaatcaaagtattccagaaaatttaaattaagtgctgccacgttctgcatggcctcatcagacacttaaaaacaacagcaggaccaccagccaagagtacttttaagttatgtcctccccatcagtctcagtgaaactaaacatacattaattactcatttagtgtcttctctctctgtgtaacttactccctttccccaatgcctgaatatttataaattcagtcatttagctaagaaggtagcctggtttaaatattttaaatacaattgaaacttctcacatcctggctccttggtgcattaatttgcgtagttcttaagtcacactcagtcacaacataactccatacagaagtgttctccaaaggttaccattgttagaaggaattgaactttatcttaattttgtataggaaatagcagtagcagttcagttctgtttaattttatttttccattagaaagcatattccctctgttaatgggaaatttccacaagctaatgtttacatatcctacttttcaccccctaaaattcaaaactcacttcgcaaacataaaaaggcaacacatacaggccaattggagaatgtgtaggacaaagtatccaaggtctgaggcaggtttcagagtggctactctgaccaattgctttcatcaggcttactggcttccacttcagcttcactcacatccatgcatattgccagttgctttctgggaaaaaaaaaccacaaaagttcattatttggaattgtggatgaaatgaaatacacctatgaacatttcataccggtttgaaattatctatcctcgcaaccgctccagcacatttttctgtgatacctagccccaggattgcattaggtaggaatggttgtcctttgtgtgcagacttttttttttttttttttttttggacagagtctggcactgtcaccctggctggagtgcagtggcacaatctcggctcactgcaacttccgcctcccgggttaaagtgattctcctgccacagcctcctgagtagctgggattataggcacccgccaccacgcccagctaatttttttgtatttttagtagagatggggtttcactatattggccaggctggtcttgaactcctgacctcatgatccgcctgcctcggcctccctaagtgtcgggattacaggcatgagccatcatgccccacctgtgtgcagaatttaagagagcactaaaacactcacgattcaagatatctctgtctatgtatctatctatgtgtctatcatctatctaatctatctatgtatctaattttagagatagggtctagctccgtggcacatagtggagggcagtggcatgatcacagttcactgaaacctcgaactcctgggctgaagcgatgcctcagagtagcttggactacaggtgcctgctaatacgcaccactaattttacaaaatattttgtggagatggagtctcactatattgctcaggctggttttgaacgcctggactcaagtgatcctcctgacttggagtcccagagcactgagattacaggcgtgagccacccaccagcccgaagattaataatttttaatgcaaatattttaaaaatcacgaccgatgaaaaaaaatccacaataaccaaattgtcaaaattttcaataaaggcaagatccaatcctgtaggactcactttcctcacgctgatgtcaatcgcgattccaataaaacatttacaaaaacaggagtctagccaaagtttcccagtttgattcgttgatacactgtgtgaaaaataccttaatgcccagtaggcatcgcccccgccccacagctcaagagcggccttgagccccatacttagccttgtggccttgggccttgtggccttgggacccctacatagccaggggccttgagccccctacataacttttgactttggaggagagggaaggcgactggggcagagccaaaggcggccctagaagagccctagcgtcctgggaactgggcacctccagagcaagctgcttaccaagcgaacatgtccggatattgagaaggtcagaaaatgctgtctagctccttcaggtgcaacccgccgaacgtgctggggctgaatagacgctcctgatcttggggttgcggatcctcagcggaggagtcctgggccaactcctcaggctgctgctgccagggctcctggtggccaccaccgcccttctggttctcgtggatcatggggtccgcagctcccgcgtacacgtgactttcttttcctgctcctgctccctgctcgggtttggtccgtattttcttctcatcgtctcctccagcttcagtcactgaagtctctatatccttcgcatctggaaaggaggaaagggaaagagaggtcggaggagagagctggagagagagagagagatcagggcgtttggcccagacacagggcagcctagacccgtggctgagagagacagcgcagtagcctcgggttcacgctcctctctccgggaaagttgctttccaagagttcaccaaatcaccggttcgggtccccagacaggcactgaccgtcttctttctggagctcatcgaacaggaaacccaggccgaggtcgccggtgtcttcgtggccggatctgggctggaacgccacctgggagcgtggtcgacgaagccgtgcgtctccgcggattctgcgctggggtcctctggctcctggtccgagttccggcgcgtggacttcgggtcggacgcctgcaggggacagggagtgggctgctgctcaggacgcctccggtggctgtgtgtgtgtgtgtgtgtgacagagagagagagagagagagagaggagagggagagagagagagagagaggagaggggaagagagagagagagagagagagagagagcgagccttgctggcacgcgctctcggccgggcgtggccgtaaagtcaggggcgcgctcctggtcaggcgcggggaggtggcgggcaggtgtggggaaccgcgctatattttgcggtttccttgaccactcccaccctgggcggggtgagtgccagcaggaaaaggctgagcggtctggtgggaacctatttggggcagggggaggggcggaggagcgagacccaatctagctccggagcccttggagaaagtttgcgcaacacgtctctgtccagccatccaggcaggcaggcaggccagaataatgcttccccaggagagagccgaggcaagctgaagtcagtgcacctagcggtgtgggctcccggcaccactctccccactgggtagctggtgactaatggatgagcctctccagttctgttctgttcccacccaaagtccgctaataggaccgtaattaagatgaaatgaagaggtcgaagactgcatgctaggtttctgcagcaacatccagaaagttgagggcgccacactctccaaggggtctgcggaagcgggagtttggggctgcgattttcagggcactatggatgctcagatgcaagctgcaagaaacctaacacgccccttgcaaaagctgcaggtactccacgtcagtgtacaggtatagaaccctgcctggtgtttagtgcatctaagaaggcttacactgcaagtgtcccttccataggctctagatgagactgcggagcgtgcaatgtctgctaactatgcaccgctcccacgccttaggtttcaggctcgctgcagaagcgcgagtgctccatgtgctgggtgggcactgtggacttgggttagttcccaccttcccttgctcctcatccccttctgttacccaccctcctcgtcctcctcatgcttctcctttcctactctttgcctagaacgatcattctgaccttttgctccttaatgataaaatgtcaaataaaaaagagccagggcagattgggagctccacgtttctcccttcaagaaatgtgcctcaaaacgatgaatctgtgttcagtgagctatgatagcgccacttcactcaagccactgcactccagcctgggcgacagagtgagaacctgtacctcaaaaaaaaaaaaaaaattgtgcccccagacgattctgggcccggtggtgcggacctgtaatcctagttactcctgacgcttttgcaggagatcctttgagcccaggagttcgagagcaacctgagcaacatagaaagacccccatctctaaaaatataaaaaataaaaatagctgaatgtggtggcatgcgtctgtcatccaagctactcaggatgctgaggctgggggatcgcttgatgccaggcattggaggctacagtgagctatgatcacaccactgcactccagcctgggcgactcagtgaaaccctgcttaaaaaaaaaaaggaaaagaaaagaaataaaagtaaatttaaaaaaattaaattgttccttgaaatgagttggtttcctgaatattgggataatttatccaatttttgcataaccaccattgtcatcagacccatttaataaaataaatcaaaccattttcataggcccttgaaagtatgcccactcactttgcccgctgtgccagaaagataattctctcctttctcctgttcctgagagggcagataggaaaccagctacaggatgatgggttgaccaattgactctgaaaaaactgtcaaggaatttcacccccacagactctccctgacattaaccaagatgtctcctcctcaagctgcctcttgcagggttctgcagacctcacccttctcgtggccagacaccctgtgatgaattttggcctgggatccgttattatgtgagagacttacaatgattttaatcatggtatgtattagcccagctatgacatctgttagaattggagtcctgtggtgtctcacatctgagatttccatgacttgcttcagcgctttctcagcttcagtagtcatttctgtgctcctttggtgagtgttacctaccggagcaccaaccaaggtagtatttactttaaaattttagttacattgattcacttcttgcaaatgttatgttccttattgagcgtcagccaggtaaaaataggcacaaatgatgggtttgatgtcctaaatttatgaaggcagggaccctggagccagactgctggcatctgcattacggcattgcttgtcatttgctagctagctaacctggtgagtttgttctcttgtgcttcaattttctcatctgtaaaatggagtaataataatacctacctcatggagctgttgtggagattaactgagatgatactaatggtagctcacacttacctggttcttactgtgttctaggcaacgatctaagtgatttgtttatgttaacatatttaatcctcttaacaaccctatacacacgttgatgtgctattactgtcattttacaggtggtgttattaagtcacggagatgttaaataccctgctcaaagtcactcacttgggaaatgtccagagctgggatttgaacccatcctctgagtactgtccctgacacagacgacgtgctcaataacctttgctattatgctataattagtgttcttttgtaattagtaaactagagataaacagaaatatatgtatcatttagctcaaaatttccttcacttgtttgaatatcgaattagtgccatacatatctagtggtacctctactctgttaattacttcttttactgtgcagaagctttttagtttaataaatgccatttgcatatttttttgcctgaaatgcacagtcttatttactatatccttattctttgttggaatgttgccttagaactatagaaaagtagtgatacattaaaaaaaaaacataactaagtgtctagggataagtggagataactggaatgactagcataagccagaaagccaaaaagcattctttccaactctgacatcatatttcttgttggcctaatgtgttaatgctatacataagtcatgatacctagggaaaaagtaaactacagacagcttgcgataagtggtataattagttgaatccaataagatgaaaaacatattctcaagtctaccttctaatttcttctggaaataaggagttaataatacagatatctgggagtacctaaagaactagttaagtagacacaagtaaagttaaatagagaactacatagtagctcattatataaaacccattttccccaaatctaaaccctaaccactcctaaccccttagtatttgcagagtatattaaaaaacacagatatattgaaaaacacagcaggcaagggtctctgcctttgcttcaggctctcagagagatgagagttattattcctggcagattgtagcaacaaccatccaggtgtatgtaaagaacattcttgcaaatgtgtgtaatctcctctgatctaacatcctatgggtaggtggagatgaggcaagaggaaaagactacagtagcaaatcatttcatttggatacttaataaattaagtaaactactaaattatttgaccagcttgcatttgtaattatatgccaaaaagtatgcttttttattttatattgaaatcatatttttttctttggagaagaatggaattggtggtgaagtgtcacaaagtctgaaatttacctgtgaacgtttcagcaaaaagcaaagaagcaaaagcacatgcacacatagctatagaaagaaaatatagcaaaatgttaacaaagtttgaacctacttggtgagtataccagtgttactgttcattctttaaagttttctgtatgtttgaaaattttcattaacaatttttaaaaaataaatggaaggtttcaacaaagtacataaacccaaaagccttacacttaacatctaaggctcaaatagcaacgaagtttgacttctacaataaacaataaagacccttggcttttatttcactaaagtattgccacattataagcattgccttaaaacgtctgctctcaaaaagacatttggggttatatggcaaaagtgtcaaagcaaggcactgaaagaccaaagaactccatgtaaagattatcctaaaccgaattgccttgggatttctaaaagtactgcaaacactacccaaggctgattttgtccacgtctagcgatttccccacctccgtccttggatgccggcattccaagtggctcacaatatctcccagccaaacacactgaaattcttagacttaagacaagtatgccacagagcagccttctgacactgcaactggggacaatcagtgcaccctcacttctctctccaccactcctcaacatcttccccaagatcctttattttaatttttttagagacaagatctcactctgttgtccaggctgcagtgcagtggcctgatcatggctcactgcaacctccacctcctgggctcaagctatcctcccgtctcagcctccagagtagctgggattacaggcatgcaccaccgcgcctggcgattgaaattttattttatttattttcttcaagacagagttttgctgtgttgctcaggctggtctccagctcctgggctcaagagagcctcccgcttcagcttccccaatagctgggactgcaggtgaacaccatcatgcctggcatcccccaggatccttgagccttaagtattgcacgcacctctcaggcagccacacccaccatcagagtgtggtcaagcccatgaaacctcaggcagccccactgagcttgctgacgatttcactttgcacaggctagggtggagtatggcagccccactgagcttgctgacgatttcactttgcacagggctagggtggagtatggcacccccttctccattccctgcagatcttccttaaaaaaaaaaaaagttttccttttattttttcattttagttctccatgtatgtatgtatgtatgtatgtatgtatgtatgtatgtatgtatgtatgtatttatcttgttgcccaggctggagtgcagtggcgtgatccaggctcactgcaacctccgcctcccaggtcaagtgattctcctgcctcagcctcctgagtagcagggattacaggcacgtgccacccatgcctggctaatttttgtatattcagtagagacggggtttcaccatgttagctaggcttgtcttgaactcttgacctcaggtgatccgcctgcctcagcctcccaaagtgctgggattacaggcatgagctactgcgcccggccttatttatttattttgagagggtacatgtgcaggtttgttacatggatatattatgtgatgcagaggtttgggcttctattgaacccatcatccaaatagtgaacatagtacccaatggatagtttttctttttaaaatttttatttatttatatattttttaaatgcaacgtagttgttattgtaagtgctcatccatttaaaaataaatctagactgggcatgcaatagctcatatttgtaatcccagctactcgggaggccaaagctggaggatcacttggcccaggagttcaaggttacagcgagctatgatcatgccattgcactacagtctgggtggcagcgtgagaccctgtctctaaaaacaaaacaaaacaaaacaaaataaaataaaataaatctatactgccttacatttttggattttgttttccattgacaaaaacattagaatcgatttttccaaagcactttcttttctcctataaactttaaagtaggtttaagatgtgcatactcaaaaatcatatgcttatgattctttaaattctttaaaaaacaaaattctgaaataatttttacaccttacagttcagcttaaaagtacatctgttgcagtaacaaagcattcaaccagcactttcctgacaagtgttaccataagctacataggctacaactgtgtttaagcacttttattatttcacaggagttattatgagctgccagttctcctatttgcacagttcattcacactttttaaagtagtttcatattcaccattttatttgcccctctcaattgccccctaaaggtgaggcacccaggagacttctcattcctattttaaagttgtggaaaccaaagtaggacgtaagctagttaccacactgggcccacaattcaagtctcatgagcctgcaattcatgcccaccaactgccgcttcatccccttaagctatctttcagggcaaagagaactctaactaaaaggatacaatagcttgattgccaaacctgcagcgacgacttctgtcaaaatatttaccccttgtggcccttggaagataatgtgctaagtgaactgtagagttaagatagcaaggtgtggggcaatactgacacccacttgcagataggtcagaaaatttctgttgtgcaacattcactccaacacatagttcacttgagcattatcatgatccagttatctggcttgtttgtgcaccctggttgatgcaaaggagaactcccacatagttctctaagtataattatagcaaatgtacaacatttgattaacatggcaattgattctattcatgaccctcagtcactgctggctgctgggaaaagactgagatacagaatgattttaaagatcaataaaattcttctccttaaaaaaaactcattaaaaaagtaaacaaaatcttccatttcctaaattagaggcaaaaagacttaactatggttcaccttgttctctcaagcttttactattaagctcagtttaacttccttcaaacagcaatcacttgtgtcataccccgcagttaattcacaatgtccagtttcttccatcatcataactgggacttcatgtcctgggagacaggacttaaccagtttaaagactttgatgtcagtgtagtggtccaaaggcattcagattataataatgtattgcaataattatcgagcagttactaaatatcagacttccctgtattattttatatatatcctaaattaatcctcaaaaatccatcaggcaggcactgttatatccactacttgacaagaactgaggcacaaagggtaagaaaactgcttaagttcacatagcaacaaatggccaatgaaggacttgagccagggccttaacgtcagccactacaccaaaactgcctagtcctcaactataatcccagatcaatcattaaacgaatcacatgaccttgggccagtcatttcatacctctaggcctccactgtaaaaagagacgcactaggtgagctttcacgtgctttcctgcttttaacgttctgccaatctctgcctggattgctcccctccagaataagtgctgtaactgctaagactaaaatttctcagtcactgtgagttcctgttctagtacattcctctcactcttcagggtgctagggtccagtcttcactttgggttttattttcaaatactcaactgcaatgctaatcctaaatattctctctcggtctaagatcacctttctctactactaggggtaagcaggaccgaccccactccacacttttaccccattactccagcccacatggcagctgcccaggcagcccagaaggaggcctaagaaagccctagaagcaaagccataagaataagtcagttttcctagaggtcaaacaaggctgtagggcacctgccaagcctcccgatctcgttggcagtattccatagtgtatatgtaccacattttctttgtccaatccaccgttgccaggcacctaggttgattccatgacttaactattgtgaatagtgctgtgataaacaaataagtgcaggtgtctttttggtagaatggtttctttcggatatatgcccagtaatggggctgctgggtcaaatggcagttcttttattcattattttattgtaaacttgtctttctctgttctatgttgtcagtttttgcttcatgtatttatggctctgtttttagatgaatatgtttataattgttatatatcctttactcaattttttgtttttgagacagaatcccactctgtcacccacgctggagtgcagtggtgtgatcacagctcactgcaggcctgaactcctgggctcaagtgatcctcctgcctcagcctccccagtagctgggactacaggcatgtgccaccaagccaggctaatttttttttttttggagagacagggttttgctatgttgtccaggctgtggtagttctatttttagctctttgaggactctccaaactgctttccacaggggatgatcaaatttactttcctaccaacagcatataatcattcccttttctctgcatctttgccaacatgtgtgatcttttgccttttttataatagccattatgactagtgtgagaatggcgctctgaaaactggctagccatatgcagaaaaatgaaactggactcctactcttcaccacataaaaaattaactcaagatgaatttaagacttaaatgtattttctttatatatttttttagagatgaggtctctgtcacctaggctggagtgcagtggcatgattctggctcactgcagcctcaacctcccaggctcaagtgatcttcccacctcagcctctcaagtagctgggactacaagcatgtgccccctcacccagctaatattttaactttctgtagagacggggtttcaccatcttgcccaagctggtcagactcctgggctcaagtgatcctttggccttggcatcccaatgtactagattacaggcatgagccactgcaccagattattaaagagttaactgcaagatgtcaaactataaaaatcctgtaagaaaatctagggaaaactcttctggacattgtcctaggcaaacaatttaagacctcaaaagcaagtgcaacaaaataaaaaattgacaactggggcctgattaagtgaaaaagcttctgtacagcaaaaccaacgataaacagagtaaacagtccacagaatgtgagaaatatttgcaaactatgcattcaacaaaaaactaacacccagactctaacaagaacttacaaatcaataaaaaaaaacccatcaaaaattgggcaaaggacacagacacttccctaaagacatacaagtgggaaacaaatgtgaaaaaagtattcaacctccctgtcacccttttgacagcccttacttcctactatgttcgcaattggtgggttcttggtctcactgacttccagaatgaagccgcagacccttgcggtgagtgttacagttcttaaaggtgatgtgtctggagtttgctccttctgatgttcagacatcttcggagcttcttctggtgggttcagggtctcactggcttcaggactgaaaccggagactttcaaagttgagtgttacaactcctaagccagcgcatctgaagttgttccttcctcccagcaggttcgtggtctcgctggcctcaagagcgaagctgcagaccttcgcggtaagtaccacagctcatagaggtggtgcagattcaaacaataagcagcaataaagtttattgcaaagaggaaaagcgcaacacttccacactatgaaacattaccagaccagattaccactgcaggctcaggcagcctgcttttattcccttatctggccccacccacatcctgctgattggttcattttacggagagctgattggtctgttttacagagagctgattggtccgttttgacagggtgctgattggtgcgtttacaatccctgagctagacgcaaaagttctccaagtccccactagattagctacacacagagcactgattggtgcattcacaaaccttgagccagacacagggtgctgattggtgtatttacaatcccttagctagacataaaggttctccaagtccccactagactcagggcccagctggcttcacccagtggatcccgcacctgggcggcaggtggagctgcccaccagtcccgcgccgtgtgcctgcactcctcatcccttgggcggtggatgggactgggtgctgtggagcaggaggcggcgctcgtcggggaggctcgggccgcacaggagcccacggtggaggggggctcaggcatggcaggctgcaggtcctgagccctgccccgcggggaggcagctgaggtcctgcgaaaattcgagaggtcctgcgaaaattcgagtgcagcgccggcgggccggcgctgctaggggacccggcgcaccctccacagctgctggcccgggtgctaagcccgtcactgcccggggccagtggcgctggccggccgctctgagtgcggggcaggttgagcccacgcccacccggaactcgcgctggcccgcaagcgccttacgcagccccggttcctgcccgcgcatctccctccacacctccaggcaagctgagggagccggctccagcctcggccagcccagaaaggggctcccacagtgcagtggcaggctgaagggctcctcaagcgtggccagagtgggcgccgaggccgaggaggcgccgagagggagcgaaggctgcaggggctgccagtacgctgtcacctctcactaccttgcatggatggtggagccatagtgattgggtgaccatcctggcctcactgcctgctgtgtgaccttggcttttctaataatgttctttgagtatttcagatttatctctgaggtgaaatgtgcttaatgaggcccctggaatcattctaagacccttgtccttagaaagaagctaatgatcctctcagtgtgtggctcggaggaagtgacaaaatcatgacttcctgacatgataaatggtccgctgttctgtggtccagctttcctttcaatgctcagttgctgggctgaaaagacaaccatattgactctagaatgtcagttacaatgtctgtcctcacaagggaagtcatgatcaaactgaaacaagcaaggtgttcccatgctagatgccagagacaggtttacccgtgggtgaatgatgcagttcttgtccatggtataggatgggatggtgtggtgtcaggggagggggcaagaggggcactggaagtaagagagtgggagaagaggaggggtccctgtcaaattcccctcaatcctgagagagacacttaggaacagagtgtctctgctccctctggatattcccgtgtatattttgaagcctgggaggcaggatggaggacatcctgctgatgcctgaaggatggcaaagcagaatagaaggatgctcccttaaccccatgaccgagcctctgaattaaccagctccagtgtttaacctatctctggacttatttatttttttattttaatttcaactttattaaaatacagtgtcccttttgatttcatttttttttttcagaaggaatttcactcttgttgcccaggctggagtgcaatggtgcgattttggctcaccgcaacctctgcctcccaggttcaagcgattctcctgcctcagtctcccaagtagctgggattacaggcatgcaccaccacgcccagctaattttgtatttttagtagagagggggtttctccatgttggtcaggctggtctcaaactctcgacctcaggtgatccgcctttctcagcctcccaaagtgctgggattacaggtgtgagccactgcgcccagcctacagtgtcccttttcttgtgacagtctttatctaaaacactgcagctgatcgcacacaagaaagcccacctggggaaagtattggcctccctgattggtgaaccatttttgccaacagcagcaggacagaaaacatgagagttgtcacagagacacaaatatgctgaaataaataaaaagatatcccatgttcatgtattaaaagacctgatagtgttaagatggcaatactgtttaatttgatctactccccagattgattcagtgaaatctctcaaaatcccagctaacgtcatttggaaattgacaagctgatcctaaaatgtacttgaacactgaagtgaccaagaattgccaaaataatcttgaaaaagttaaacatttagaagactcacacttcctgatcttaaaacacactacagagctacagtaatcaaaacaatgggatactaccataaggataagcatatagaccaatggaatagaatttagagtccaggaatacactcatatatgtatgggtaattgattttcaacatgggcattaaagccattcaatggggaaaaataatctttttaagaaatggttctgggaaaactggatatccacatgcaaaagaatgaagttggaccctgtataacaccatatacaaaaattaattcaaaaggaataaaaactttaagagctaaaactataaaactcttagaagaaaatatagatgcaaaattcatgacctttctatagtcaatggattcttagatatgacaccaaaagcacaagcacagaagaaagatagataaactggacatcatcaaaatttaaaacttgtgtgcctcgatggacactattggcaaaaagtgaggaggcaaaccacagagttggagaacaattttgcaaatcacacatctgataaaatatatctagaatatgtaaagaatgcttaaacttgataataaaaagacaatccagttaaaaagggggcaaaggatctgaatagacagttctctacagaaagtatacagatgcacaataagcacaagaaaacctgttcagtatcattagccataagggaaatacaagttaaaagcacaatgaagtgccatttcatatccactagatggctataataagaaagacagataatacccagtgttggtaaggatgtggaaaaattgggaccttcctacactactgtgtatgtgatgttgaaaagcaatttggtggtacctatcaacatttatacatttaaagattttttaaagcactttgcaaaaataagtaaaagaactttgctttcccttagccattccactcctgagtagtatcctacagaactactcacatatatgcctaaacaaggcatgtactatatttattgcagcagaattggaaagtttcagttagacaggaagaatgttttagaaatttattgcacagcatgatgaccacagctaataataatgtgttgtatgtttcagaattggtaagagtatattttaaacattctcatcacaaaaaataagtaggtgaagtaatggatatattcattagattgatttattctttctacaatatatacatgtatcaaaacatcacattttaccccataaatatatacaactgttatttgtcaattaaaaaatttcaacacaaattaatattaaaaataaaataaattgtaacttaaaaaaggaatcctagggcggccctcctgcccaccctctttctcccgtccatctgtctgattctcttagacttcgtgttcttttttctgtcttaatctcaacttgtttttaaactagattgctttgagaagatgactaaataaagtttccttttgattaaaaaaaaaaggaaacatcccaagtgttcactaacagaatgacctatggagaataaactaataggagaataaactaattcatagttctttccttatgaaacaactatggaataccatactacagtaaaataatgatatagactagggtttgtgaaactgatattttagattgtatagttcttagttgtgggtggctgacttgtgtgttgtaaaatgtttagccctatcgcaggtctctatcagtaggtgtcagtagcactctctcaccgcagctgtctcaaccaaaatgccactagattgccaaatgctgagggggtagcaaactagtccttagttgagaaccactgatggtagccttatatttactgatgtgaaaagaactccaagacgttttgttaaataataatttagaaatagccaggtatctctttgatgtaccaatttcatttcctttgaataaatacccagaaatggaattgctggatcatatggtaagcttcttatttaaaatttttgagaaacctccaagctgttttctataatagctgtacttatttacattcctattgaaaatgtacaagaattcccatttctccacaccctcaccaacacttgttatcatttgattttttaaataatagccattcgaatgggggtgagatgatgttgcattgtggttttgatttgcatatccctgaagattagtgatgttgagcaccttttcgtatacctgttggccatctgtatgtctttggaaaaatgtctactcaggtcctctgcccatttaaatttttttaattattatttttgctattgagttgtatgaattctttatatattttagatactggctcccttttgaatatataacttacaaatattttctcccattctgcaggttgccttttgattttgttgatgattttactgactgtgcagaaactttttcttgccgtgtaatggtgatactcatttcacaattgatatgtatatcaaaacattatgtttaacatcttaaatatatgcaatttttgtttgtagattataccttaataaagctgggaaaaaagaatgaaaatgatatgtgcaggatgattcaaattctgtttttaaaaaactatatatttgtattggtaatatgattatgtatgaggatacaaaggaaaaatgtcaaggatacatactaaattgaaaacaatggttacctcaggagagagggctaggattgcatgagtgttcatgcatgttgaaggtgtggggtaaggagaagaggggcctttggttttactgcttgaattgtcaaagtttaccaaaaatgtgcattcatagattacttatataatttaaaatgtagttaaataaacttatggaaagcattttgtagagagtaggtcaccaaagaagcctacactcttactatatcagctgccaaaagagatttggatgagtgcttaattgtacttagctcatgatttaatcctcaaatacctataatgtgcaatttctgttagggactgaaatgattatgtcatttcttttaccaatcagttataatctatatttaatataatgtcagatgattctatggaatttagaaatggaaaaaaactggcatttaaaattatagatataatgtacatcaaaaacctatcactgtgactagcacttaatacttcataaatggtacttgctaatattgttatacatgttagtatgttcgaaaacattgttccttcagcattcactagaatacaacaaaagttttatttttttctagttttttatctgaatcctatagtgtttacaattccagttaggacacttttaaaactgagatcacactttcaacattcattcatcctgtatggtatttaacaatagagtaaaaaagtaaaagctcaaattattacaagttaattgatgtttcctatagtcaaatgccacgaaaagggaggtgaagaatttggaccctaatgctgattctgaccaactctcattctttctggtcattttgtcaatctgtaagtcaacagagcagaaacagctaccattatttatttattaaaagagtgtagttgtcacttggaataaggagttgcatgttcagtgctaaaggtaaccagataatatgaagatctgtaaccagataatatgaagatctgaaaatgtataactactgtaaagatagtgatattccatgtatatacagcaattccacagatgacatcagggtctagtaagtaagaaaaaatcatttttgatattgatattttatccaatttaacatttgttctgatgctgactttaaacacacctgcactgtgtgatttatgttgtcctcatcatacaaggcaaggtttacagaaggagggaggtggctttcatgctgagagtgatactcttttattgtactactccatgttaattaggcaatgacttgttacatgacaaacttcatgtaatacagcctctagtctttattttgtgcttcacagatctcatttctctggaaaggaagaaagagaacgagtagttgtatttctattacagacagtcagggatatagaagactattaacaacattactaagtctattactaaatctgtcaatgtgtagttctgatatctttccactttgccttcggaggagaaattacacactaagtttatgtccttagatgaatttcacagctgaatagtgagggactgcaaaataaccggtgaaaatgagagttggtcagaatcagcattagggtctgaatttttcacctttctttatggtatatgctatggaaaatatcaattaacttgtaacttgagctttacctttttactctattgctaggagtgaatcatattacaactatttgaagctagaagactgtagtggtgctgtgtatcttggatttctcttgattttttgcaagtgcagttagccagaaggtttttttattttttattttattttattttattttattttatagcagttctgactgatgtggtccagctaccctcagagccactgaccttgggccaatatgttgcctactcttaagtattttgaaatactgcatggaaaaaaatgtcatttatttggttgtattactatatttaattagttgaatagatatggttagtttaatttgttaacttggctaggtgatggtacccagttattcaaacactaatctagatgctgctgtgagggtattatatagatgtggttaacatctataatcagttgctttaagtaaaggagactgtcttggataatcttggtgggcctcatccaatcagttgaaatgccttaagagcaaaactgatatgcccagaggaagaagaaattctgcctgctgactgcagcctcagtttccacctgagagtttctaggcttcccaagttccctacagattttggacttacctagctggaccccacaatcatctaaggcaattccttgaaacaaatcaaatacatatataccctgttggtttttttttttttttttttctgaaagaaccctgactaatacagattttgaaactagaagtgggatgttgctgtactaaagacctaaaatgtggaattggctttggaattaggccatggatagagactagaaaaatttttgagaagcgtgatagaaaaaaacctaaattgccctgaagagactgttgttagaaataggaatattaaagttgattgtatagaggtcttggaaagaaatgaagaaaatgttactgaaaatgggaggaaaggcaatgcttgttatacagtgacagaaaacttggctgaactatgttcttcagtcacatggaaagcagaacttgaaagtgatgaacttggatatttggcagaaatttacaggcaaaatccttaagatttttctttgtgaaccccaagatctttaccctaaaatggttctgttgaattttaccctgacaatgtaaattgatagcttatcttcataacctggtttctccttgctgcttatagtaaaatgtaatattgatacagacaggagacagggaaatactgggtagaagagggtggtttcccagcaaaggccccaccctcaagtctggaaacccgtggccctaaatgggaacaagcgttcctgtttttgtgcccaaatgctgccttttggcctgccacgcccctgtatcctgtacctgtataaactccaaaccccaggatccacaagcagatgagcagacaagcagaagagcagaggaacagaagagtggtgtggcagagaaggagagaagagaaggagcttctgaacatcaagaggagttaggctggggacggtaggagaggagatcagccaagggacgactgaactccaggggaagattatcttcccactccattccctttccagctccccatccatcctgcagagagccacctccatccagcaataaaatacgccacatttaccatccttcaatttgtctgtgtgacctgattcttcctggatgctggacaggaacccagtaccaagagggcactgagctgtttaacacttaagctgtccctggatggcagggctaaaggagcattgtaacatccctggatattgctgtaggcccagagcccaaaagtgcttgccctagctcaaatgcgtgctccccctcccataaggggtttgagcatgcagtggccaaacagacgagccacacccctgttgcaggccctgcaaggggggtcagtgaactctcccatttcaatgtgaaagatataaattgaggaaagaactattaggcaaaaagtaactagcacttgattttggaggttctcagcctatcgtgattccaaaggatgccaaaattagaaaatttattgtcgcaaaagcatactctgaagagaaggccaacagtatggctggacaatcttgctaaagagattatatatgtgattcatggatccaatcaaccatatcagctgaaggcaggaatagagatgggtttatccaggaaggatcttgtctaatgacatggactcccataacacacacgagactgataaggattttgagaatgttatatcaacagaaatactggcatcttggagtaaaggagatagatatgggatgaaatgaaggaagactgttggacttctggaaatctataggcaggatatgagctgacagggctactagactgcaaagacacattagccttcaagaaaaaggaagagtgaattatgagggtggcacagaagctggtggatcactgcaagaccagatggcagaacattgagctaaagaggattgttcctaggccttgaaatctaatggaattagctatgctaattatttatttatttacttttttgagatgaaatctcattctgtcacgcaggctggagtgcagtggtacaatctcagctcactgcaacctccacctgccaggttcaagcaattctcctgcctcagcttcctgagtagctgggatgacaggaactcaccacaatgcccctctaatttttgtattttagtagagacgaggaggggggtttcaccatgttacccaggctggtctcgaactcctgacctcaagtgatccactcacctcagcatcacaaagtgctgggattataggcgtgagccaccacacctggccctgccatgctaaattttgaacttacttgggacaagaaaccactttatgcctcccatattcattcttttggaatggtaatgtcttgtaaaaggaaaataaatctcaggactccaaaatcattaagccaaagggaaaagtcaagctgggaactgcatcaggcaaacctacctcccattttattcttaaataagatagctacaaacaaaaaaaaaagctacatacatgtctcacaatttgtccactgggacattccttttgagccccaagatgtttaccttaaaatggttctgttgaattttaccctgacaatgtaaattgatagcttatcttcacaggttctagacaaagaacagaactcaaagtcatccttctgttcatctgagacagatgcatatctgattgctttcctaatgtaaaaatgcagattcactgagctgacaaaggcataagtaactattcctctacccttctctcacatgtaaactgtgtattcagtgaaaggtttatcaaacactcaaaataatgcaaccatttgtctgttatctacccacacctttaattttttttccttttcccccaatatctgcccttttgcctttaaatactgaagtccacaaaatcttctttggaaaaaggcatagacctgccttccagatgcatgttcttaaccttggtaaaataaaatttccaagttaattgagacctagctcagatactttttggtttacaaattggtaaccaccaagggattctgagtggaggtgcccctgacctttgacaaatcttctattactgcttggtaccagcttgagatatctttattgctcaaatcaataggcagatttgctgaggcctgggaacttcccccctccagacaatcccttgtagcaggacgagctgcagacaaaatctttcagacactgagttgtagaaggaagggctttattcagctgggagcatcggcaagctactgtcttaaaatccgagctcctcgagtgcacagtttctgtcctttttaagggctcataacactaaagatttcacatgaaagggtcgtgattgattgagcaatctagggggtatgtgacaggggcttcatgcaccggtagtcagagtgaaacagaacagagcagggagtttcacagcgttcttccatacaatgtctggaatctatggataacatcggttgctaagtcatgagttgatttttaactactaggtttaggccaggcaggcccaggcctggtttcagttctggttttgggtctggtgcctggctgcctgcccttggtttcacttccttgtttttttcttaaaacaggtactgagtataaaacaatataaaacaatatgagagggtccgtctcttccctcaccctgatctccccaaatttggtcgatatctaaggtttttttttgctgtacaactccttttctggagttttactcactttcaacaaggaaggtgagttttcctgcttccatgatgatggagggcaggcaactcctttctggagtttcagctcaattccaacagggaaggcgagttggagtttttttcctgcttataggctggtagagagcagtgttgagcctggactccattcctaggtaagtagctgaattggggttttatcttgaaaattctccttaatgacctaaagttaagattaacaaccagcagctcttaatttctccttaccattagagtgctcaggaattgtatacatagtatgatcatttgtttgttttgccaaactgttttttcatttatttgtttgttttgttgttttggtctttttcccattggatttgactaactctacccaactatatcaaatgtgaaggaaagttacaaatggtgaggaacaacgcctctgcattgggtaaattcctgcagctgggggggaaaagggaaaaggataaacagccatcaacaggaaaaaagaaagattttgactacctgaggggctttatttacataacaaggccaccttttgctagccaagccaaactgtgctccacactgcagttctgtagctaaggttttgcccttttttccaccacaacagcctgggtttggttcctaaatcaagttctttctggtttgatatttgtgttatttttgaaatatcagcaatttgttccagctaaaatagggtagtgagatttagaagaattttttaagagcttagtggctaaaagtcagtttaattaaaagctaatatccacgatgtgtgtgtgtgtgtgtatatttaaaaggcctttatggttttttgttttgttttgtttgtttgagaaggagtttcactcttgttgcccaggctggagtgcaatggtgcgatcttggctcactgcaacctctacctcccgggttcaagcaattctcctgcctcggcctcccaaatagctgggattacaggcatacgacaccacacccagttaattttgtatttttagtagagatgggatttctccatgttggtcaggctggtctcaaactcccgacaacctcaggtaatctgccttcctcagcctcccaaaatgctgggattacaggcgtaagccaccgtgcctggcctgttttttttttctctcctagtaccttgttttttgagaaaaaggttttttccttctcagtcagtcaaatgaattctgttttctccatttacttctgcctatctctcctttctcttgttcccctctgctgcatgagggacccaaaatagtttctaacagcctgtaattccttaaataaaacagagaaggcactagagtcctttttgaggagaaacatctgtttttccttatggaaccccaagagtctaaacagacaagttcctctcagatcttaaactgcttgcttttgtactgtgttacctgatttttggactaagttattacaacagaggctactcttcgggtgtttaagataagaaaaggtatactttagacacttagaggaaagtctttgtaacaaagtgcagtgcaaatgcatcacatggtctagaatcatgataattctatcttttggagatccaggattcagcgtgggctctgcccagagctgagatccagttaaaagctagagactaggctgggcacagtggctcatgcctgtaatcccagcactttgggaggccaaggtgggcagatcacgaggtcaggagttcaagaccaacctggccaacatggtaaaaccccatctctactaaaaatacaaaaattagcggggcatggtggcaagtgcctgtaatcccagacacttgggaggctgagggcatgcccagccgatgctacacttttaaacagccagatgtcatgattactcactatcattagaacaaaactagaggggaaatctgcccctatgatctaatcgcctctcaccaggccccatctccaacactggggactacaatttgatatgcctttgcaatatcaattgctgcataccaagttctctctgttttgggcctctgtaatagtcacaatgtcaggtactgctggtgccaaaggtggtattacgcattgagctgcctaaaatcagtggtaagtctccaagaaaccaaggtcttgtgcacaggccagatggggctattgaatggagaaacagtctcatgaaacattttggcttccttaagctcagcaatgatggcaattattctttttctcccctaggcagctgacattgttttttgggaaacaacagtactaggtgttggtcatcagatgggtccatggtcttctatatttctcactaagatggccataactattgcaattcctgtcagggcttggaggcaaaggcaagtggggctgcacatggaaaacacatcactgccaatatttcattcagtagtgggggccatgacaacggaggttagtaggagcccaaagtcagagaacacgatctgttttctcctcatcttgatgcaagggtttgtggggatcacagtcacctgtgtactggtatctaaaaggcctaagaagtgcaattcctctccactgttcagttgaactctaaccttggcatagggcctctgggtcccctgagtacagaaggatcttgtttataacccctaaaatctttggatttttgtttgtaacccctaatcttgtttatatttgaaagctgagtgtcagagcaaaagttgctcaggatctctgatttgtctccaaatccaccaggagaggtggaaggccatcactgtgcagactctagcgggaccacttatcaaatccccatggcctggtacttggccctgaattttttagtggggagcccatcaatctgctttcgtggttccattattgagtaatcagactcagagatctctttgggaaggcccttgcccagacagtccagaagagggcactcaagtactatttttatgctccctttttggaggggaggggtcaaattttgctattttatcggaagccatttcttctgtgcctgagaatttctgagttaagatctggatcacactgcagattgatggacttgacctcaggaggtggcttaattgggcttgacaacaagcaggagcagcatgaacaaacccgtaaatctaagtctggttaatcttctcatctaccgttcccactccctcgtagtagacccaagagaccaccaggagggctgcaggacctccatagtctctgcgaaggtggttgagacatgtttttcagtgactaggtactcattatgtgtggaccaaatctgtcagagaccaaatagtacccagctgaggaaagagatggtcgttggtatacatacactctcatctccccaccttgctcctcctcctcagagaaagtggccactatcaaggcactatggaggagggggtctgtagtgatgtacccctcaaggagccactttcctttatgaagtttatttaacaagattacctttttcgtaatggaagcaaactagccaagtctctgtggtttcttcccctaagcaagtcttccttctggcttggctgctgggcattgaccctatctagtgagatcactggacaaagtgattctaaagagctctacattatttttattagaagcatgagtctcagtaacatgctgcatggcatgttgtccgtcagccccagggaactgcttagatctaggaatagttttggggtacaggtcagtttacagggtctccaacgacttctggccccatcatcagagaacggtgtccagggaattgtttctgtggcttcttagagcccctctgctggatctcttatttgatccactaggttatctcagccgaggtgatggggataaacaggaggaccgatggttaccttggaaccaaaagcttttataaacaattttctatcatcctccaagtataccctgtgacttacaatagcaattcctgagacctgctggcatggctggtaaagtgccacgtgaggtctgctagcacttcccaggactcactggcagagtgcccggtcagatcctctgactctggcaaataatccattagcatcctccaggagtgccctgcaaggtctgcttacacccatcattagtgaattgccccacgagattttcaggctctttgctcttcagaaacgacattgtgcataatcaactacccagcttgccattccaatttttcaagagctcagctgagctagagagagctgagctgctgggtgtcagagtagtcgattaagacgagtcaaaataaaagtaacagtcagactttaataactgcctttgatagtataagcaagggactgaaccagaaaaagtaccgactcctccattattccatttttccacatggggtggctccaacaggggtctgaccacagatgcagggcatcatcatctcactgttaagggagccctgaacaagaggctcctgccattttatggacccaggggcaggaggaggtgacagggaagggctaggagtagaaaagtactgagtactgagtcagcttgaagaaaaaaatatttttaggcatcccccactcccaccatggcaacaagaggtcttagctcaggtgcttgagaaaggcctctgccaaaggctcctgataaggcggactccaaatggaggcatctggtctaggaatgccgacatgtgtgagagcatgatcagttcgggacgtctgagtccttgactgcaactccattcacagactgcaatgcacggctgtgcatcaggtctgatgtggggagggcacgtccccccatgatccctgccaggtaaagcttttgtaattgcctatggcgaggcctgaaagatcacccataggtttttggccaagagttgaattcactctctccagtggtcctagcacttcctgtgagaggtcttgctgtcattgtctctaaaagcatgaaacaaaggaagtcagatctctgcccctttggaatgcagctactgtggggctacgtgtttctagtttccattacagaaatactgaatccacccgtgcccctaccacacccacaccgggaactcaggagaaggggaggcagggctgtggtttctggcctgctgtggcactagaaggttcatagcggtgagtctgatcggctttctgggtgtcagaccagacggaagaaccaaagccagtcaccatcatcagtagtattctagctctggagcttacgtgttcaccaatgacagtgtctgcccaaatcttccttctggcttggctgctgggcattgaccctacctagcggaagcttaggacacacctatccctggaattctgggcaaattctcccagctcaggagagtggtgggctgtttttggttcctctgctttttaaattctatctgttatggttagtatcaggcctctgagcccaagctaagccatcgtaacccctgtgacctgcacgtatacatccagatggcctgaagcaagtgaagaatcacaaaagaagtgaaaatggccggttcctgccttaactgatgacattccaccattgtgatttgttcctgccccaccttaactgagcaattaaccttgtgaaattccttcacctggctccaaacctcccccactgagcaccttgtggcccctgcccctgcccataagagaaaaacccactttgattgtaatttttcactacctacccaaatcctataaaacagccccacccacccctatctcccttcactgactctctttttggactcagcccgcctgcacccaggtaaaataaacagccccgttgctcacacaaagcctgtttggtggtctcttcacatggacgtgcatgaaatttagtcccttaatcatcatcactgtggaaggtaatgtttattaaacacctacagcatggcaggccttgttctgagtgttctacttgaatctcttcatttcatcttcttttcagccctatgaactaattactgtgaaaattccattgtacagatgaggctcagaaagctaaaacaacctgcctaaagtcacaaatccagtaagtggcagatctgtgacttgaaaccctctgtctgcattgagagtctctgttcctcctatttagccacactgactcccatacttctgaaaccgcctttgcaaaattatgactaagacagtgaaagagatttaacttaaccaactccattttgcttctaacctccaagctgtccttgttcattcctgggcgtaggcccaactaaccttggagaaaaacttagtttatagtttgaacaaagatggtaatagcctttcccaaagcagacttccttcttgcctgggaactagattgcctttgtaggaccaacattggccacaagactagaaattatagtttaggagtcatgcagctggaggctacaagattctaacccttcctaaactgctcctaagatcagtggttgagatattttgtaaaccctgcacttgatggatcagctggcaccacccaaatggataaactggctcatctgatcttgtggccgccacccaggaactgactcagcacaagaagacagcttcgactcgctatgatttcatctccggccaatcagcactcctggctcactggcttccccccacccaccaagttatccttaaaaactctgctccctgaatgctcgagaagactgatttaggtaataataaaactccagtctcccacacagccggttctgcatgaattactctttctctattgcaattcccctgtcttcataaatcggctctgcctaggcagtgggcaaggtaaaccccttgggcagttacacttcctcctcccaccccagtgccctgacccctccatgccatctcagcagcatgatgtttacatatgggtcctagatttgtgtagtgttttccaggcagcaagcttagtatttcttcctggatacagaggacattcaacgaagcacttccctttctgtattgcaattaagaccaattgtcttaaggtgggaaactactccacatacaaagcatagtggttaaaggcaggggttctgatacttggagatgtcagggactaataaagttaataaaattgggtcctgacataggttattatctttttatttcactaattaaggacatttaaaacaaca[132 bp omitted]aagaactagtctccacacataataaaaaagttagctgggtgtggtggtgtgtgcctgtggtcccagctacttgggaggctaaggcaggaggagtacttgagcctgggaggttgaggctgcagtgagctgtgattgcaccactgcactccagcctgggtgacagagtgaggctgaaacggcttttgcaaaaattacaacactgagaaaattatagcagtgaaagagatctgatcatgccaaagtcccatcttgcctttggccttcaagctgcccctaattattcctgggttaggccaagctaacctggagagacatttagtttatactttaaatgataatagccctttcccaaaattcaactgcctttgtaaagctaatgagagaccaccaggctagggggatagaggagcctaaattctgctaaggtgtagacataaacgattgccagctattgttctggaggtcacaagatatgctacttccccaattactcctccagataacattactattgtagaacctaagactggccttttgagatatcttttcagatttgtttgcctgtctgacaccaatggcttcacctggacctgccagccactcctgtggccccacccagaagatattcagtgggcagaaggaccattcctgcacccttatgattgcacccccaaccaatcagcagcaagcacccattgcttagccaccctaactccctccctaaaactatctttggaaaaccctacccctaaatgctcaagaagattgatttgagtaacaattctatctcccatgtggcgtggccagccttgcatcaattaaattcttttatttactaccatgccatggtcttcatttgtgcagcaggcaggaagaacccatcaggtggttacaatcctctctcaaaatatttaataacagaaataatatctaaaccttgtaaagaaagattacaatgtggcaggttctgctctcagtctttcaatgaaatatctgattcaatcctcataaaaatcctgttcagtaagcttgttatccccattttataggcaaggaaattgaagaaaaagaaacaatatgtaaattgcttctgcctctgctgataaccattatagttagcatactataatatactgtctctctctttcataaaagacaagagtaacctttaggcccacaagggaggccctgatctcagaatttaggaatagccaagtaaaacacagacacctctgagtttgagccttgggaaaatgagcattgtgtctgtttcctgaaatttaagatgaaaacactaatatctgttgtgaggagtaaatgacaacatataccgagtatttacacagtaactggcacataagaacctccgaatacataccagctgtaaggcttattgtcactcttcctccttgcacagccctatgagttcatctcttgctgggaaggagctgagtatggatactacagactggtcctgttattgaggtcagataaatttgatgttcctccttccctcactctctcccatttcctcctccttgaccgaactgaaacgggcagaaatatttgggctttacttcccattggttgaaattgttgctataacagcattcataagcattctttctgggaaccctgggtaagagctgcttaaagacttctgaggcttcttcagctactgctgctggtactccaaacaaggatctgatcattcatgtatcagagtttgttaggaatggggactgtctacaaaaaaaagtacctacagtggttctccccattcatcaccaagaccccacacttgaccatgctcccagctctttctgcccattctgcctacctagcatctcattaggaaggtacagataaaaaaagagctagaaaaggtcattgggaggatcaagaatgatttgtccccacagatatgtaaggataaaatcctagtattttccttctcccgttggaacacagggctccatggagaaagttctaaagagggtcttcccatggacaaagacttcgccttaattgcttggtgttggcggtcatgattttgactcctggttaattcatcaagagccattttgccaaaatccaagtcacagaatgaccaagtgaacaagtgagccattcttggagcaatcaagttgccaatgactagttcatgcaagcttaagaaattaactgatttacaaaacactttgttgtttttgcagagtttactacaatttactctgagtgaatgggcatggcataagggctatggagagccagttctataatgttctgtgccttcagacatatcctctcccatcggtcggtctttccccagtctggaatgggcagtttcaggagactgttttcccccagtagatgaccctctctcccatccccaacccacagctacagcaacaggaacttagctgaagccatccagctgacgcccaagaccattccagtcaatgaactaaggacaagcgtatgagtgtccccccacccccatcccaaccccatgctccagacctaccctcatggccactgagtgggacactggaaactttgccttcctgagagaacggggctctctctgagagtggaaacatctctgttgtcttggctcccagactgctgccaccacagtgcaaccacccaaagcaaagggaatcatggaagctatttcacgtatgctgacaaagccctgccccagtcctaggggacctcccaccaatgtgaagaggtgtgtgtgtgtgtaatacaattgtgggggcttttttctttttttttttttattgtactttaagttctagggtacatgtgcacaacatgcaggtttgttacatatgtatacatgtgccatgttggtgtgctgcacccattaactcgtcatttaatattcggtatatctcctaatgctatccctcccccctccccccaccccacaacaggccccggtgtgtgatgttccccttcctgtgtccatgtgttctcattgttcaattcccacctatgagtgagaatatgcggtgtttggtttttggccttgtgatagtttgctgagaatgatggtttccagctttatccatgtccctacaaaggacgtgaactcatcattttttatggctgcatagtattccatggtgtatatgtgccacgttttcttaatccagtctatcattgttggacatttgggttggttccaagtctttgctattgtgaatagtgccacaataaacatacgtgtgcatgtatctttatagcagcatgacttacaatcctttgtgtatacacccagtaatgggatggctgggtcaaatggtatttctagttctagatccctgaggaatcgccacactgtcttccacaatggttgaactagtttacagtctcaccaacagtgtaaaactgttcctatttctccacatcctctccagcacctgttgtttcctgactttttaatgatcgccattctaactggtgtgagatggtatctcgttgtggttttaatttgcatttctctgatggccagtgatgatgagcattttttcatgtgtcttttggctgcataaatgtcttctttcaagaagtgtctgttcatatcctttgcccactttttgatgggttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggctttcgttgccattgcttttggtgttttagacatgaagtccttgaccatgcctatgtcctgaatggtattgcctggttttcttctagggtttttatggttttaggtctaacatttaagtctttaatccatcttgaattaatttttatataaggcgtaaggaagggatccagtttcagctttctacatatggcaagccagttttcccagcaccatttattaaatagggaatcctttccccatttcttgtttttgtcaggtttgtcaaagatcagatagttgtagataacaggactctgttctgttccattggtctatatctctgttttggtaccagtaccatgctgttttgattactgtagccttgtagtatagtttgaagtcaggtagcatgatgcctccagctttgttcttttggcttaggattgacttggcaatgcaagctcttttttggttccatatgaactttaaagtagttttttccaattctgtgaagaaagtcattagtagcttgatggggatggcattgaatctataaattaccttgggcagtatggccattttcacgatattgattcttcctacccatgagcatggaatgttcttccatttgtttgtatcctcttttatttcattgagcagtggtttgtagttctgcttgaagaggtccttcacatcccttgtaagttggattcctaggtattttattctctttgaagcaattctgaatgggagttcactcatgatttggctctctgtttgtctgttattagtgtataagaatgcttgtgatttttgcacattgattttgtatcctgagactttgctgaagttgcctatcagcttaaggagatttggggctgagacgatggcgttttctaaatatacagtcatgtcatctgcaaacagggacaatttgacttcctcttttcctaattgaataccctttatttccttctcctgcctgattgccctggccagaacttccaacactatattgaataggagtggtgagagagggcatccctgtcttgtgccagttttcaaagggaatgcttccagtttttgcccattcagtatgatattggctgtgggtctgtcatagatagctcttattattttgagatacatcccatcaatacctaatttattgagagtttttagcatgaagggctgttgaattttgtcaaaggccttttctgcatctattgagataatcatgtggtttttgtcattggttctgtttatatgctggattacgtttagtgatttgcgtaagttgaaccagccttgcatcccagggatgaagcccacttgatcatggtggataagctttttgatgtgctgctggattcggtttgccagtattttattgaggatttttgcatcgatgttcatcagggatattggtctaaaattctctttttttgttgtgtctctgccaggctttggtatcagcatgatgctggcctcataaaatgagttagggaggattccctctttttctattgattggaacagtttcagaaggaatggtaccagctcctccttgtccctctggtagaattcggccatgaatccatctggtcctggactttttttggttggtaagctattaattattgcctcaatttcagagcctgttattggtctattcagagattcaacttcttcctggtttagtcttgggagggtgtaggtgtcgaggaatttatccatttcttctagattttccagtttatttgcgtagaggtgtttatagtattcgctgatggcagtttgtatttctgtgggatcagtggtgatatcccctttatcattttttattgcgtctatttgattctcctctcttttattctttattagtcttgctagcggtctatcaattttgttgatcttttcaaaaaaccagctcctggattcgttgattttttgaagggttttttgtgtctctatttccttcagttctgctctgatcttagttatttcttgccttctgctagcttttgaatgtgtttgctcttgcttctcaagtccttttaattgtgatgttagggtgtcaattttagatctttcctgctttctcttgtgggcatttagtgctataaatttccctctacacactgttttgaatgtgtcccagagattctggtatgttttgtctttgttctcgttggtttcaaagaacatctttatttctgccttcatttcattatgtacccagtagtcattcagaagcaggttgttcagtttccatgtagttgagtggtctcgagtgagtttcttaatcctgagttctagtttgattgcgctgtggtccgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtcttggagtctaagtctctttgtcggtctctaaggacttgctttatgaatctgggtgctcccgtattgggtgcatatatatttaggatagttagctctcttgttgaattgatccctttaccattatgtaatggccttctttgtctcttttgatctttgttggtttaaagtctgttttatcagagaatagggttgcaacccctgcctttttttgttttccatttgcttggtagatcttcctccatccctttattttgagcctatgtgtgtctctgcacgtgagatgggtttcctgaatacagcacactgatgggtgtgctctttatccaatttgccagtctgtgtcttttaattggagcatttagcccatttacatttaaggttaatattgttatgtgtgaatttgatcctgtcattatgatgttagctggttattttgctcattagttgatgcagtttcttcctagcctcgatggtctttacaatttggcatgtttttgcagtggctggtactggttgttcctttccatgtttagtgcttccttcaggagctcttttagggcaggcctggtggtgacaaaatctctcagcattttgcttgtctgtaaaggattttatttctccttcacctatgaagcttagtttggctggatatgaaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatttgaatgttggcctgccttactagattggggaagttctcttggataatatcctgcagagtgttttccaacttggttccattctccccgtcactttcaggtacaccaatcaggtgtagatttggtcttttcacatagtcccatatttcttggaggctttgttcatttctttttattcttttttctctaaacttctcttctcgcttcatttcattcatttgatcttccgtcactgataccctttcttccagttgatggaatcagctactgaggcttgtgcattcatcatgtagttctcgggctgtggttttcagctccatcaggtcctttaaggacttctctgcattggttattctagttagccattcgtctaattttttttcaaggtttttaacttctttgccatgggttcgaacttcctcctttagctcagagtagtttgattgtctgaagccttcttctctcaagtcgtcaaagtcattctccatccagctttgttccattgctggtgaggagctgcgttcctttggaggaggagaggcgctctgatttttagagtttccagtttttctgctctgttttttccccatctttgtggttttatctacctttggtctttgatgatggtgacgtacagatggggttttggtgtggatgtcctttctgtttgttggttttccttctaacagtcaggaccctcagctgcaggtcttttggagtttgctggatgtccactccagaccctgtttgcctgggtatcagcagcagaggctccagaacagcggatattggtgaacagaaaatgttgctgcctgataattcctctggaagtttcatctcagaggagtacccggccgtgtgaggtgtcagtctgcccctactggggggtgcctcccagttaggctactcgggggtcagggacccacttgaggaggcagtctgtccgttctccgatctcaagctgcatgctgggagaaccactactctcttcaaagctgtcagacagcgacatttaagtctgcagaggtttctgctgccttctgtttggctatgccctgcccccagaggtggagtctacagaggcaggtgggcctccttgagctgcggtgggatccacccagttcgagcttcccggccgctttgtttacctactcgagcctcagcaatggcaggcgcccctcccccagcctcgctgccgccttgcagtttgatctcagactgctgtgctagcaatgagcgaggctccgtgggcgtaggaccctccgagtcaggcgtgggacataatctcctggtgtgctgtttgctaagaccattggaaaagcgcagtattagggtgggagtgacctgattttccaggtgccatctgtcacccctttctttgactaggaaagggaattccccgaccccttgcgcttcccgggtgaggcgacgatgcctcaccctgcttcggctcatactcggtgcgctgcacccactgtcctgtacccactgtctgacactctccagtgagatgaaaccagtacctcagttgggaatgcagaaatcacccatcttctgcgtcgctcacgctgggagctgtagactggagctgttcctattcggccatcttggctccaccagttgtgggttttgttttcttcagtgccatcttgacccaattttgaggccctggctagaggctagtcagttcctcttcttgagcagctgattaaatccacatctcaaccatttcccttatggggctctcacattcctggcaactatgtacctgccctaatcaccacagggataggtaccagacaactagggacagcccttttgcctaagtttcaaattaacaaatccacagggagcccatgaaacctcccttgccatacctggactgcctcctacaggtatagctctatcctgcgttacaacttcaggtgtggctctacctggcagccttctctcatttggagctgtaagtaacaaagagttctgcctttcatctatctgaatatatttatgtggtatccttccatccaaggaccctatgttcctgtctaacattttataattatgaaacaatatgggcataaagaggacaataagggaatctagtcccctgcttgtttctgattttacatgaggctctccaaatttaaggtgggtaggggaccataagtggatataaatacaattgccaacagcccacaaatgtggctctgggcactatgtcaatgagttagccctgcttcacaaggaacagctccagttaagtaaaagattgctgtttaataccaccaagtcacccttgaattctttcctgggcaaagccaagaactctcccaggctaagccccagtctgggggcttgcctgccccacgtcatctgaacacatactccaagtaattttctaggtttaacagaatttcaattaacacagaaagataagcaagaaaacacacggtcgacctaaaaataagtatggaattcacttaactacatatttattagaaagacaaaacattaatctttaagactgacgatgactgaaaaatgaaatactagtcaatcaaaaagagatgtctgaagtagctgttggcatatatgacattaacaggtgccaaatatatatgtagaatgatggaagaaatattgttttccttgttttgaaaaaagaagaatggcttctgattgcttctgaatgcgagtacatgaaattgcaggaaatactccacaaagtagttgtatatatactgttacataaaccatatcaatatactgaaacactaaacaaaatatgcatatcttggaatgatgggattcaaacaagcagacctatggctgtattcaagctttgatcatgtcttactttttaacacgtgagacttccaaatcccagtgatactgtgagttcacaaactgcttagcattcacccgggcaaaggaaaatggctttatcttttgaaaaagatgtcttaatccacagttaacttttttttttttttaagagagaggatctcactctgttgcccatgctggagtgcaggagcgcgatcatagcttattacagcctcgaacttctgggttcaagtgacactattaacgttattttctaaaacaacattttttcagttttcctttcttattatattcattgcatatatgttgccttacttcctaacagacaataaatggatgggttaatgattataaagaaaaaaatggcagcacagaaaagggaatctaatgagcaaatagaagaatgaaagaaaaatatctagtacatacccagcagtctattctgtttaatttgtatccagaaatattgtgtacttatatattaaaatgaatccttaattcagcataatacccaagggttagatttagtctggttaatggactgttttaaagaaatgagattgaacaagaatcccatgtcattgtttatttcctcattttctttttattttaattaactaatttagagatggggtcctgctctgttacccaggctggagtgcagcggtctgatcatagctcactgcagctttgaactcctgggctcaagcaatcctcctatctcagcctcccaaagagctgggactacatacaggtgcatgccaccacacccagctatttttttcctagagatggggtctcactatgttgcccaggctggtctcaaactcttggcctcaagcaatccccccacctcagcctcccaaagtgctgggattacaggcatgagccactgtgcacagcttatttccttattttctgttgaaaaaaaatgtgagattatgtatgtctattttcccctcacatttgagtctactgaacagaatgggatgtttggtcaatgaattccattatagccacttgtcagctgtgatttggacagattatttaatctctctctgtctttatttcttcatttgtgaaatagcaataagcttaattcacacacagtacttgtcacacattaagccttccaaaaattttagctgttacgataatcattgcccttttaaaaattacacataaagcaccactgctagcttccgtgaaggaaacaagaagagtaggagacccagtctgaaaatgcaagtgcttaccatgcaggtagggaacataagaattacacccacaaaacagttatgtttcagtgagaggccataagtcatgactgttgcctcttaattagcgattgagacttcaggtctacagggggtctggaaggggagacaattgggcaggtgaggttgagaaacagaaggaaaaagaagaagatgggtgaaaggaggcagaaaatgtgagaggaaaacagacatgaatgatttggctagatgaggaaaggagtataggaacagcacaagcaaagatagtcagaaatgagcatggtatattccagagattcactgtgagtttgtagtgtctaatatggtttggctgtgtccccatccaaaatcttatcttgaattgtaatccccataatcccaatgtgtcaagggcaggaccaggtggaggtaactggatcacgggggtggtttcccccattccgtcctcatgattgtgaatgagtctcgcaagatctgatggttttataaacatctggcatttcccctgcttgcacttcctccatcttgctgccctgtgaagaaagtgcctgcttctcctttgccttctgccacgattgtaagtttcctgaggcctccccagccatgcagaacagtgagtcaattaaacctccttcctttataaattacccgggcttgggcatttcttcatagcagtgtgagaacagactaatacagtgtctaagagccatcactccaaagagcaaactttattgccatggcgttagctgaaaaacacttaggctattagattgaatgtgtgctgatccctgagactttctctaaatagttatataaagcaacacatatggaaaaaacagctaagcaaagaaaaagattcagcagaggaaaagtggctttcttggttatttatcttttcctgcaataagtatgcaatcatgattaattcaagttccctcctagtgttattctatttaactgagatattgatgtacaatattagaatgctaccaattgtgagagggaacaagacagtttgggcatggtgcctaaatatcaggagggtgttaaaagagttattcagagtatcatttttattttgcctatggattgagtctttcctatggttcataggggaaagaatggtgagaaggagcagagtgagatgaatgaaatttgatctctgtcgttggctgtggttgctactcttggacagtaactcgatgaccatgaagaagacttcctcatttcatcacatcctgcatgttgactaggatcacagctggcagctagtctccttccttccagttcagaatgaatggactaaacatttacttagtggagagttatgcaaaattttgatactatagaatgtgttcacctaacgggttgagccaagaagaggctcctaaatctaagtctgtatgttaaataaatagaagagacgatttagcatcttacaatatttctgtcggactcacttttggagttgacctttttgatgtggcgggtaggcctgtggaatttctgagaaatccttggaaattctttgtgcttaaaatgaatagaatcatattttgtgctccttgaggtgctggggttggggacctgggccagggaaaatcagattgtgaaacctccactcagtctttactttcctttcttccttataaataatttcaatcccactgaaaccccttaatgtgaccagatgagttaaagggaggatagggatcagaggtaaagagaaattggtcttactgcttggcctcgtgatgagggctatggaaggagatgttagggactgatttatatagggaccagagttccatttttcctttttttttttaatggtaaagcccagctggccagagctacctccttgtgccccactggctaccttccagaggcagtacctagctgctagccgctgtttatcatcaagctccccacacctcaacaacagctccaggctcagccattgccatggatttctttcctcctatgtctccacagactctttcaccttttgattttaaaacatcctttgtttaatttttttgtttctctcgttcaaagggaatggacagagactcttccttgttctctgccttccctccattattttgcctaaaccaagattcttcggcttgaaacaaaaaatcataatccaactctgcagttctcatagaggccctagttttgtctgtggcctgtgctttagaggggtccaaatgtatcaattatgatgctcacacctgaatgctacctctgaaatcatctttgtccccttgcttgtgtaacacaacagaacgtgcttttagaaggggtcttttgtattactagattctaaaatattgacagaacaatttccaacctgttagcctgctttcttaaaaaagttaattcaacaccaagcaccaagctagttattgttcatgtgttgtgcttccagcttcaggcacagatttgcaagaagattgggagaaatgagagttgtgaggagggtacaagttgtatcactccctcaagggcctgtaagaatggacaccaagatactgaatgcctttaggggaggttgtttactattcctagaggtaaaatggcccagtgccatgattggggaagggacttgaatcttcaaccctttaagtgaaatagttctgggctagataatgtggtaggtgctgaagagctgaacttgggctggtgtgtgtttctcttaattgaatgatctctggcccaggggagggcatggccattcagcggctggcctcttctaagctgagctatgtgtgttctcttacgtaggccactccattgctctgggcctgcagaaagccctctacagtgctgtataaaggatatagtcaaaagcaggtcagtataacagagttcattttagtggaattcaaatgtaccattggccaaatctctacatcaggataaccgtgttttgggtccatattcccaatactgttttcataaaatagttttagtatatttgcaaaagggaggagagcatctgctaaaagtttcttggggaaattcatgctatagtttggaaatagataaaaacatactttgttttcactttaaaaaaaatcttcggctgggtgcagtagcacacacctgtaatcccagcactttgggaggcagaggcaagaggatcacttgagcccaggagtttgagatcaacctgggcaacatggcaaaatcctatctctacaaagaatacagaaactaggtgagtgtggtgctgcatgcctgtagtccgagctactcgggaggctgaggtggaaggatcacctgagcctgtgaggtcaaggctacagtgagccaagattgtgccactgcaccccagcctaagagatagagtgagaccctgtctcaaaaaaaatattttgtttggttcattttccctccagaactccatagaggactgtataaattcacataaggagaaaaagcaactcaccaaaccttaagatggtttctcaaaattcccagaccctggtatacacacatattctcccataccaggacactgaatgcctttggaggaggttgattactttctttagaggtaaaaaggctcaggcttaagacagagccttgagcctgcaggcctttgaaggaaagcattctgggcaggatggacttggtaagtgctgaggagctgaatctgatatagtgagcacttcctgtatctgggtgactggggagctaaggaagggcatggccacttagaagctggccttctccagggtgcagtctatatgttctcttttgcagaccactcccttgctgtgggcctgtgttccttcatctgtaaagtgaaaagagtaggctcgatgttccctaaattctctccattgtttacgcaacacatcctccaggaaggactccctagccaacacaggtgggactggggacgaagtgtgggcttgtcccttcagatatcccaccctcaacagacagattgtaccataagagcagaaaacatgcctgggtcatctttgtgaccccatcgtctagccaggagctgggaacagagcaggtatctccaacagtctgtgtaatatatacatgagaaactgttcaggcaagtaatcttgacaacccctctagcaaagttctgctgttcttttcaaacctctccattcacgaaatcaagtggtggctaagacatggtcatcagataacactgagctcaaatcctggccctttcaggatctttggcaggtcatctatagcagatgttgtctgtgtcctactagatctcagccatatgtacttggcccaatttgcaacagcttgatgcttcctctggggtctgaagcccctctgcctgaacagggaaggctggggaataaatgcccccaggagcagccctcaaccaatgattattgggagttggtggataaatgcccaagcttccttgccccttagacagaataattacgaagtgattgttctacactgtgagaaggtgataagcagtctgtactagtccgttctcatactataaagaactacctgagactgggtaatttataaagaaaaaaaggtttaattcactcacagttccacaggcttaacgggaagcatgactgggaggcttcaggaaacttacaatcatggcaaaaggtgaaggggaagcaaggcatatcttttcatggtgacaggagagcaaaaaattaagggggaaagtgccacacacttttaaaccatcagatattatgagaactcactcactgtcatgagaacagcaatggggaaatcctcccccatgatataatcacctcccatcaggcccctcctccaattcgacatcagatttgggtagggacacaaatccaaaccatatcgcagtccctgacagccagcactggcctggtacgcacaactaggtcttgatgttttcctgttgaacataaacagtctcacagagcactactgccagacaaaatcactctgtgatcttgacgaagtgagaaaaaaaataccacttcataaccttgtctaggcatagaaaaaacaagatcactgtgcaaatgaaaaaagtaccaaacacggagttcaacttccagcatgacagcttgaggaactctgctgatgcactcccaagtgaaagtggtaaatattatttttaaaacaacaacttaaagcccctggaaatggtcctaagggaaaacagcaaatgaagaaacgtctttctaagagaacctacaaaaattcaataagaaaagcaagtctgtggtatttgaatcactacagcttcttccttttcccctcccagatcagtaaggcagagattctacttcagactgctgcagacaagagcatagggctccctctcccctctggctcccagccagaggactttcttcccaagaggagcagcacttcagcatcattcatactgacaccagctacttgtttctgaggctaagtatcaggtgagtacagctgagtgatggtggctcatttaatctgccgactctgtcccccagttatttaatggaggctctaccttagatgcaacacactgaggaaaccgcggctcaagttttccttgcctcgctcatgaggtggtggttacatgctgaagaggcaagccgagagcaccttaggctgctgcaccccactctgccaaggcctcagcccatagaaaggggttgccattcaggcagaagcttgccaccgtccccaccttgtctctagagctcttgctcaaagattttgccttggaggaggaacaggctacaaaacaggtagctcctaatctcttcccaaagggattgacttcatttgcaacagagtgtaaagttcaaagctaagagtgctctcaagaacagtggacgttgtcatacaaggcagttgagatttgtggatctaatgaagataaagcatggcctgtaagctggatagttttcaggagaaaaccaggaaataagatggctggtaagagcactcctggtatcagaacaaatatcagacgtggacctcaaaaactattccttcaaataaaccacaatttaattgaattagtttgtagaacaatttatgtcctagagcattgctgaaaacaatagaatgatcagcaggcaattagtggagtttaatagttgggcatggtaagggaaagacagagagccctactaacaccactgccatcctagagtgacggtgtacacacccaaagtcatgtcttcctgaagagcaacatcagaggcttaagactatgaggagaaggaataagcttcattaaaataatccagccaatcactaaaaaaaatataccagcaaataacaagtcccagaggccagggttgggggcagttgctacaacatattatcaaaaattttgtggccaagcataatgcttcacacctgtaatcccagcactttgagaggccaaggtggaagaatcacttgagcccaggagatcaagaacagcctgggcaatacagagagaccccccatctctacaaaagtaataaaaaaaaattagccaggtggaatggtgcacgctgatagtcccagctactcaggaggatgaggtggaaggatcacttgaacctaggaggtcgaggctgcagtgagccatgattgcaccactgcactccagcctgggtgacagagtgggaccatgtctcagaaatgatttcaatttccagcaaaaagtttatgaggcatgtgatatggtttgtctatgtctccacccaaaatctcatcttgaattgtaatccccttaatccccataatccccatgtgtcaaggatgggaccaggtggaggtaattggatcatgggggcggtttcccccatgctgtcctcgtgatagtgagtgagtcccacatgatctgatggttttataagcgtctagcatttctcctgcttgcacttctccttcctgctgccttgtgaagaaggtgccttgcttccccttcaccttctgccatgattgtatgtttcctgaggcctccccagccatgctgaactgtgagtcaattaaacctctttcctttataaattacccactctcggctatttccttataacaatgtgagaacagacaaatacagacctgcaaagaaacaggaaagtatgccccatacagcagaaaaaaagcagacaacaccaactgcctgtgagagcaaccacatgatggatttaacagagaaagacttcaaaatacccattataaatatgtttgcaggccaggtgtggtggctcatacctgtaatcccagcactttggaaagctgaagcgggaggattgcctgaggccaggagtttgagaccagcctggtcagcatagcaagacctccatctctacagagaaaaaaaataatatgtttactgaactaaaagaaagcatgattcagaaaataaaggtatgataacaatgttgcatccagtagaaaatatcattaaagagatagaaattattttaaaagaaccaaatggaaattctgaatctgaaaagtacaataactgacatgaaaaaatcactagcaggttcaatagcacatttaaactggcagaagaaagaattagcagatttgaaacaggattgatagtgattatgcaagatgaagactagagagaagaaagagtgaagaaaaataaatagagcttcagacaaatgtaggacaccatcagccacacaaacctaagtgggatctactagaagaaaggaagagatagagaggagatgaaaggaagagatagagaggagcagaaaaaatagtcaaagaaataatggcagaaaatttcccaaatttattttaaaaacaataacctacacactcaggaagctcagtgaattctaagaaggatatatgtaaagaatccacaaacagattacatcatagtaaaaccggctaagatcaaggagaaaatcttgaaagtggcaagagaaaaatgtctcatcacttaccccagtaagattggtagttgacttctcagcagaaacaatgaaggccaggaggcagtaagattaaatactcaaaatgcttaaagaaaaaactatcaaccaagaatcctacatccagcaaagctacctttcagaaatgaaggcaaagacattcccagttaaataaaaatgggaggatttgttgttagtagatccacctcacaagaaataatgaagttcttcaggttgaaagcaagtgcttcagatgttaattgcaacctatgagaacaagccaaggcccactttatccactgcctctttcccttccagcctcacaagtgtcagaaagtctcagccacaagtctgacataccaggataaaaaccccactttatcaattacagactgaatatttttgggaagtaacagccactctgggtatgacagttaatactgagtgtcaacttgattagatagaaggatacaaaatattgatcctaggtgttctctgagggtgttgccaaaagagattaacatttgagtcagtgggctgcacagggcaaatccacccttaatctggtgggcacaatctaatcagctgccagtgaatatgaagcaggcagaaaaatgtgaaaaggagagactggcctagcctcccagcctacctctttctcccatgctggacacttcctgcccttgaacatcggactcccaagttcttcagttttgagactcagaccggatctctttgctcctcaagcttgcagacagcctactgtaggacctcgtgatcatgtaagttaatgcttaattaactccatatatatatacatggaggatatatatatatatatggaggatatatatatatatatatatatggaggatatatatatatatggaggatatatatatggaggatatatatatatggaggatatatatatatggaggatatatatatatggaggatatatatatatggaggatatatatatatggaggatatatatatatcctattagttctgtatatatatatatatattctgtatatatatatataagttctgtatatatatacatatatatatcctacatatacatatatatatcctacatatgcatatatatatctatatctcctacatatacatatatatatatatatctatatctatatcctatttgttctgtccctctagggaaccctaatgcactggatctcaaagtttctatggtgagaccaaatgtttaaagatgtctgatgtccccaagaccaggagaacaagggagtaaggaaagagagtgctggaactttatgacttcaggcagtcactgtctctctctgggcctcaacttcccctttgaaaaatgagaatgtttgccctctctaagaataccagacccaaagtgctcaggagcatttctcaagattattggaagtgtcaaaatgagaatcagatcaagttaggaaacattttaaagtttattgttatacagtaagagaaagtacagctcatgacccaggagacttcaaacaaagtggtagaaagctcaccttatggcagtcatagcacactttataaagcataaaggagaatattttgatttttttttgtggttggctgttttacgttatcattctttttaaggtaaacagagctgtttaaactgatttgcctatagctgattggtttaatttcactgaatcatgctgacaaagatgtaaaggttatgtttgatatttatgattagagacagtgttttggggaaattgggaagaattaaattttggttacctggttatgagtggttggccttcgggtacacctaaagtgtggcttcatttttatctttaacagaagataactgagctctcattatgtgctagggcactgtttaaattctgaatcctgccctctggtaggaagacagagattaaacaagagagccaataaccaaacaaaaaagtagagagactgcggggttagggattttagctcaggtgcttagagagggcatttgagcagaatcatgaatgcagtaaaggaggcagccatgcaaaaacctgtaggaagagcattccaggcagagagaacagccagtgcaaaggccccaaggtgggaaggagcttggtgtgttctcaagacccatgtgctcaggacccagggggcagaggaggaagcagggggaaatgaggctaggaaaggaggcagacgaagatggcagaatagaaagctccgctgatcgtcctcctgccactctgtgcaaggacaccaagttaacaactacctacacagaaaaaaacaccttcttaaaaaccaaaaatcaggtgagcacttacagtacctggttttaatttcatatcactgaaagaggcactgaagagatatagaaaacaatcctgaatcaccaatgctaccccttccccaccctggcagccatggcatggtgtggagagtgtttctgggcactggggaagagagaacacagttcttttgcttcacaattcaattgtgaagcattgcactcagcaatgtcctgttacagcagaaaggaaaaccagatcaaactcagttgatgcccactcacagagggagcatttaaaccagccctagccagaggggaatcactgatcccagcagtctgaacttgagtacctgcaaacctcaccatgaagggccaaagtgctgtcagtctctaagtaaacttgaaaggcagcctaggccataaggactgcaacttttaggtaagtcctagggctgaactaggcccagacacagtggattgggggtggcggggcggggaacacaacatgctgagacactagctaggacagccaagggaatgctggcatcacttttcccctaaccccaggatgcacagcttgtggctctaaaagagagcccttccttctgcttgaggagaggagagggaagagttgggaggactttgtcttgcatcttggataccaactcagccacagcaagatagggctccagtcagagtcaacaggcccctgttccagccctagttcccaaatgacatttctagacaaactgtgggccagaagggaacccactgccttgaaggaaaggaccccatcctgccagcattcatcacccgctaactgaagagcccttgggccctgaataaccaacagcaatgcacaggcactacattgagggccatcatgagcctctgagacttgctggcttcaggtaccaacaccaccacgggggctagagcaccaagcaggttcttgaggttccagattccaggacttgacagcatttctggacctgccccaggccagaggggagcccactgccctgaaggatgagtcccagaccaggcagcattcaccacaagctaacttaagagaccttgggccttaacggaacattgatggtagtctgtcagtgctccttgtggccaggggtggcagtggctgtggagtgaggctcctttgcctttggaaaggggagggaaaagcaggaaggactaggtcttatggtttcagtgccagctcagctgcaatacaatagaacaccaggtagacttagaaggtttttgactctagtccctgactcctggatgatacttctagacccacctggggcctgggggaactcactgacctggagggaaggacacaggcctggctggctttgccacctgctcattgtagagcccagggtcttaagcaaacatagagacagtagccagggagtggttacagcaggccttgggtgagacccagtgctgtgctggcttcaggtctgacccagcacagtcatagtggtggtgaccacaggggtgttaatacctatgtcactccacccccagctttagttggctcagaacagagagagcgattctgtatgttcgggagaaaataagagaacaagaggccaggtgcggtggctcaagcctgtaatcccagtactttgggaggtcgaggcaggtgaatcacaaggtcaggagaccgagaccatcctggctaaacacagtgaaaccccatctctactaaaaatacaaaaaattagctgggcgtggtggcatgcacctgtagtcccagctactcgggaggctgaggcagtagaatcgcttgtacttacagtggaacgttccaaatgaacaacaacacattgaaatacatttaaaaatgagggctcttggtaaaatcccttttggctaaggacgggtttggcactatggaatgttaagtgctattctctttggattaatcggtcttacactttttgctgacggctatgggtgacaggattaggcatgtgcaggaccgtgggagatggggagctttttcctccccagaaggggaatcctgacagctgatggaactgctggaaaagatcccttcactactggcaagtggtcccctgaacttttcattttcagtgtcactgcaatgaatgagtgggtccttctctggcctctgtgagctcttcaccttccccaccctgccacaggcaatgcttttctctctctcctttccctttcttatcttttctattactcagggtgaccatcttgcccagggacgtgttgaaattcctagtcagaagctggattaaagatgacgggagccatctaaggacaaatttaagccttgccagtttaatattgggtgctaagcagagtagctgatgtctatgtttcgtcacacatattttactctggcccaaacagaaaaagataattttcctttgtgttgcggcttggccccccaggtctatggtgcagcgaggtgggtcactagggccacttagggaaacggaacacagaagcctggcatgctggcaaacaggtaacaatttcttaccagtcagactcctggcctctctctctctctctctgtgcaaacaggttgaataaatggtaaaaatcactgttactctcctgtaaagtttaaattaatcagaaaaagcacttgtaaggctagtcttaagctgtaccaaatttggtatgctttgtgtgtctttccgtattttctgtcattaatgaggggtaccttaggatagaatacaggcttaggacacctgtaagcccgctgttcaagacagccaagcaaactgatcacttataagctttgctgcaggtccctggaaaaaacaaaaaacaaaacaaaacaaaaactggataaggtttccctcttgtcttgtatgtccttgggagcttgaccttgtaaccatgtggccatgctttctcttcacaatggcagcctgggttcagggttcaattcctggcttggaaaatgagtcctttaacttctgtctatggatttatatgtattatgtgtttgatgtttatatataaaagagctttcactaattggtttaaaaataataaaagcttaaataacatattttgtcagaaaagtaaaaagtgtaatgccttttagttcatgtgtcttaagtaatttttgggaaataaagagagttttaaaaattattggtaaaatgaaaatgtcaaataaggcaaacgtcgagctgtaaccaatccagccattctctatctcacttctgatttctgtatgtagtttcccttttttgtctataactctcccaccacatggctgcactggagtctctgtgaatctgctgtcattctgggggctgcccgatttgcaaatcgtccattgctcaattaaactcctttaaatttaatttggctgaagtttttcttttatcacatgagaacaggacttataatgagaaaaaaaatgaggtggaatgatggcatcctaggattgctggctttagagttgctttcaatcatattctattgctccacggttttgaatttgcttaaagttaccttctcaagtacaggttgcaaactggaagctgcatcctatatctggtctgcagatctgtttcggatgaccagtgtaattttaaataaaacatatttgaatcgattgctcagatctaaggatcagaaggtttcatgtaaacacttatttctggccaatctttacaaactggaaaatctgccagatctggaccccaaagtcctgaccagaaaaattaggctgaagcagagtagtggccattccctttgggggagacatatcctttcccagtttaccagtccccactctgcttgttttcttcatttatgttaccttcccggccctgttagcagctaggttttcgacccttactatttttttaaaaattataggaaatgtccaaaatatataaaacaaacataagatgaacactcatatagccaccacccacattcaacaattattaatatccagtcttgtttcatcagtagccttgctgatttctccaacatccctgcacccaacctgggattatttggaagcacatcgagacatcacataatttcatcattaaccatttcagggcatgtttaaatgatacaccctttttatacagacagccacagttatcactaccatagcgaaaacatggaaaagcctttacaaatatccactctgctcactttaaaaaattcctctccatattattcacttcatttgattccttttctctgtcaagaaaggacaaacagtaattgttgatctgggaaaatgggggcgagcatgcatataaacatgaatggtactccccacactctagaaaacaatgcgtgaaatgatttttttcataaggcattcattcctattttttctgattttttgaaatatgcctgataaacttttaccactaaacctactccaaatacatgagtcatgctattactgtcatgattccataggtgagatgatatggttgggatatttgtctctgcccaaatctcatgttgaaatgtaatccttattttccccaatgttggaggtgaggcctgttgggacgtgtttgggtcatgggggtggaaacctcatggcttgatgctgtccttgcaatagtgagcgagttatcacaagatctggttgtttaaaagtgtgtggcacctcccacacccactctctcgctcctgctctcaccatgtgagatgcctgctcccagtctgtcttccaccatgactgtaagcttcctgaggtcctcaccagaagcagatgccagcatcacacttcctgttaagcctgcagaactgtgagccaactaaacctcttttctttataaattactcagcctcaggcatttccttatagcaaaacaagaatggcctaacacatgagacaacagagatatagtaggttaagcgactcattcaaggtaacaaagacagcgtagagctgcagcaagaacccagaccaccttatttttaatcagatctctttctgttataccacataggaaaggtggaacaacaggttataataatatgatgataggagataatatagaataatagtagaaaacatttctgtgtgcttactctggctgggcattgtggaaggccacttacatatgttatttatccctctcatcaattctgtgatataatattatcatcttatagagaataataatgatactacagagcttaagtaaaatgcccagggggaaacagctgggaagtggtgcatctgggattggaagccagattgccctaactgtggcatcccagtgcaccaccgctgaattaaacttgacaaagcatgggctctggaggcagacaaatttggcttcagatcctgttcctctgattagctttgcaccatggataagtttcctcttctttcaatgaagatgctagaacctcactattaggattcatttgagcatcaaacaaaatcatccaaggacattattttattgcttgtcacatagtaaaggcatacaagacgttagctgctaataaaaagggaatgaaagttttaaagggtactgtctccagtaatgttctccatcagaaaaaattgtaacttgttctccacccagccccttgaactagtcccattgtatgctacctaaacaatgtgttgttcaaggtcagtaaatgacatcctaactataattctacaaatttgaatttcttaaggtccaagaactctgctttgaagttcaggatctaggttaccagagctagacaacatcttgacctataattctaacaggtacttatcagatacatgaaaacaaatgccaactgagtataggagatctcattttctacataaaggaaacatatatggctaaaaatgtcttttgatggtgtaaaaattttatgaatctgataaccacggggagggataatggaagtatgacttcaatctcccctcctccccttttacctttctttgcctatttctgagtatctgtaggctaccaaatgtttcagtctgaatgtagaaaaaacaaaataatgagcaggaatagaccgactggcacaaaatgtaccaaatggaaacaatttccagacggaatgtacactgacatgcgcgacttactgtaaataattatacaaagcacaatacaatgagaacaagagcaaaaaaaaaaaaaaaaaaaaaaaaaggaaaatctcaatcggagaagaaaaaagaatccacttggccaagaggcatgcattaatgcatagtgaattcatggactttccttattcccaccaaggcttgtggcttcaggggtatgaataaacctccttctccttgcaaaaccctcacaccaaatgcaattgcgtggctgaagcttgacacccacaattgtgaagagagaagtggggaatgaaaagcagcagacagcctgacagaaagttcatgctcacccaagaaaatggaattttccttcaggctgaaaacataatcattatgaaactggccatcaaataattttcagagaaaatactgttgtaaccatcactccttatctgcaggcattgcaatcacttcacaggatgaccacaatgttcatgatcactttttaaaaactttttggtatattttttcttttcttttgttgtggtaaaccatataaaaatttgccattttagccattaaataagtgtataatttcatggcattatttacacttacacttttacaagaaaattactttaaagaagtcttccatagcaagaaaaaacttaatgaatttttaagagtgggcatggcttccttcccgataccattttggttttgctgttttccaccctggcagtaacttgaaacacactattctctcattagggactcacaccaccccatcctgcacatgtacctggtatcaatgggggcagagaggagatgagtatggggtgttgggggtgggggtggaagagaatgtctgggtcggtgtaagcctgccatgggcacatgggaaaattctgtgacatgcacagcccccagatggtgactcaagattactgcatgagacgagagtccgtgacattcggtttgaatggcatttcttaacaatttttattgagaacttactgaccccatgtgacacacaaaacaaatgtacatacccttcacatatttatagaaacatttttacaagtgccctaaaaatgggtcaatgatgtacttttctttaaaacgtttaatagacatttgatgaactacttttgatggggtgctatgcaaaatatgaatctggctcaaagacactctggcaaaaagtggcacagaggctatcccttagacattggggaatgtgaaagaaggcacgataacaaaagggaatgggccaaattcagcctggccagcgggtggcataggtggaagaagcatgagtggaaggggcaaggacggaggaggaaagggtggcatggggaaacacaggctgctggaatggctgtggtcccagaagtaatcatctctcatcccgctgatgaacaagggtgccgttatggcctcagctgcggttaccatgacaggctggcccactgccatgaagggcagcatgtttcttgccattaatgccctctgatgtctcctccatttggctcttctattctcaaaccaaatcttcaatcagaggaaaaaagaaacaggtttagtatactgagcatttaatttcatcatggaaaaaaacacaacaagcaactctctatgtccttaaccttttcgggtgtatcaagacaagctacttccttactactaaaatatcttagaaaggtgaccaccacacctttcccctagtgagctccaagtatgtgctacgtacgctctggcctggcttatttctttgtctctctccttttatctgtaatattactttttccactcttgggtgcaggtgtagctgatgagtgggactcgatccctgctggtattgctatgtgtggcatgtctgcttgcagatacttgaccatcagctacccagctgcccaccaactcctacttactaggccactgtcaccctggtcgtgggggaagctgagcttggaaaaaaaggcgggggtgccttttaaagtcataccaagaagatgaggcccccgttttgaaaagcccatcttcagtgtaaagtaaaaaatcggtaagagtacattgtattttaaaacaagttttctttccttcaagaaattctaaggggtcattcatcttctgaaactccttgagaattaaaaagatggtatattgcaaggcaagtctcgttatagggggcccagggagtttgtggattgtcttgctgggaaatgagggtatctgaagccctggacactcttcacacttcagcttgaagctttgtggaaggaggacacaaatgttgtccaaattcacaaaaattctcaaaaagctttgcccagttgagagtttgggagaaaggaagcattgctaattctgcacgctccaactcatccctccctccaaatcttcctgggctaaggacaaggtcagctcactttgttctccctatagtcctgggatatgggacagagacttggttgcccagttccatgggacgccttcagccatctagcctcactactcgagcagaagatcccaatctcatcagcattcccaaagcgggagtgtccaaataggcaactctgaacacgttcagtagtaatgtggaggaggtatcaaaaaacactactccccaaacacctgccaattgttaaaagaccaaaaaataaaacctgtcaattaaacaacactatcccccaagcttctagttaatgacatttccattgtattttgatccttctggaagttcccaaactgcaaattttatgggacaaagggactcttctccctgtttgatgccccatttccttctcccatcttactatttggagtccttctccctcatgaatacatagtctaaattttaagcctaccgtaatagtgcttgtttagagacaattccaatgtacctgtggtcaaaggttcataaacataagcaatgccaaaagtgggccaaatgtgctatgggacaacattaggtccctagtctcagtatcggtttcataaaccagcccttactatctttacaaaacagaggggggaaacatctattaaaaatttttggagatattcatgctgaaatgtttggcaatagatgagaacatcatgcctttttccttatttgctgagtgagagtggtccttttgccttcagaactgcattgagtgaatgctatgtaaacccagggaggggaaaggcaattcaccaaaacgtcaatatttcatctcccccaaattggcattgcctgcctgagaaaatggagggcaacaggatgccaacactcagtgccccgttttgtcaggcagcttttctgcatgccaccattgacagaaccgcagcatagttccctcactgcactcacacacatgagctctgcagaaaagctgttaaggtcatcccgatttttctttcttttcttccttttttgcaaatactcctttggatccactgacctacaaatttattatcacagcctgagcaaataaataaaaaggtatttcaaattaccacaggtaagagtctagcctgacctgacagccatcccccactatcaacacattccacaaaacacatctcttcctgttagtacaacaaactggaagaaacaaaaaatctcttaaatgctagaaattgatcaagaaaatattcactgatgcatttggtagcttcaaaagttgaatgggggcagcttccccaagccatgagtgtgactgtatacaattcttgcctaacacttccatccttaggttggtggaaatttatgaaaaattgatcttgtagtttgttttggtttctagataaacttgcaaaggttgcaagccttttcgctatctctaccataatgcaaaaccaactatgtcagcaatgttttcagcctgccatatcaaagtattccagaaaattaaaatttagagctgccactctctacaaggcttcaccaaatacttaaaaacaatagtaggagggccaggcacttgaactttatgctatcccccgccatcagtctcagcttaaggaaacatacgttctggttgggaattattcctttaccccaatgcctaaacatttataaattcttaaccaaagagtttatgcttggttttaaatatattaaatagtttagtttaatggagctctttggagcattagttcgaataatccccatgtcagaaaaccccaggatgcctccacatggaagtgctacctaaaggataccagtgctaggaattcaatcttatatattatgctatatttaatttatactgttatatattatatatatttgtaatttggaatacatatatttatatatttgtaatttattcaagtgtataatatattttatacacaaggaataaaggaaacagttcagtactcatttttttttccgtggattgtcatgttccctctggtaatgggaaatttccacaagctgagctttccttaccgcattttccagccacaaagatcccaaagttcagacctcattgcctatacatgaaaaaggccacaaaaacaccaagatggcaatgtctgggtcaaagtgtgtccaagccctgaagcgggttttagaatggctcccctgcccgattgctttttcggtttactgacctgcactgcgagttcagtcacattcatgcttcttgccagcctccttctatggaagaaaccacacgtgttcagcatttggagttgtgggtgtcgtttcattcttgtgtttaatttttttattctaccaactccccacacccagtaggctgttctgtaacacccagctgagcctcacattaggaacatttctctcatgccacaaataaaggagatgccaaaaaaaaaaaaatcagggcggtggctcacgcctgtaatgccagcactttgggaggccgaggcaggaggatcacttgaggtcaggagttcgagaccagcctggccaatatggtgaaaccccgtctctactaaaaattcaataattagccgggcgtggtggctggcgcctgtaatcccagctacttgggacgctgaggtaggataatctcttgaacctgggaggcagaggttgcagtgagccgagatggcaccattgcactccagcctgggtgtcccagcgagactccttctccaaaaaataaaaaaataacccccccataacaaaaaaaatcgttaatcaatataaatgacattctaacttactatttgaaacttagaaaaattaacaccaaaggaaacccagacgaacgacggacttctcagaattttaaataaggtcagaatgcgaccctgcacttgctgtacagaaccttaatctcctcatctttatttctgcctcgcctgggataggagttatttatcataactgacctcagcccaaagttgcccaacttggttcatttaaattctgcatgatgcctaataggcatagccccactacagaacccactaggtgccaggggtctgcggggaggggacggcagcaacaccaggccccagatgggttttggttcaggaggggagagggtaggagagggactgcgggaaagccaaacgccgcctccctgcaaaccgcgcgccaaccagagcaatgggcttaccgcaggaactcactggggaactgctcgcgttggaaaatgcactccagctcctgcagctgcaatggggtgaaggcgtggacgttgggctgctgcgcgttgccaggctccagccccccgacggcgccctgtgggcgcgaatactgctgcccaggttccttctcgctctggtcgctgtcctcaacgttgccatcgctgccgctggtgccctcgaggtttccttcccataggtggccaggaactccggcgccgccgccatctttttcttctccgccgccatctttttcttctccgccttgggctcctgccgactttaacttttctcctgctgctgtgccttgctcaggctcaggctgtgcatcctcttcctcctctttgacctcttcagtaagcgacagcaccatagcattcatatctggaaaagtagaaaccccaagagaaagatcaaggcattggtcctgagggtgttggaaggaggtggtgaggggctacactctgagagcagtggtagtgcaggggtatcatccagtctactcgcctctcccagagaaccttggtttcctgagttcgcaaaagcatgtgtcccatcaaggtactgaccctgtagttctttctcgtcgtcgactgcagggctgagcaagctggtcatatactggctacactggtccggaggctccataccctgagtggtgtggatggagctgtgcacttctgcagattctgagctggggccaccacgctctcctaggcagtgctagaactgtgagtcgccgcctgcaacgttcttctggtgtctagactcagcaacagtgtatccacttagagacctcctctcttgcttttctgcttcccgctatttgctgtgggttgggcctgctgaggtgcgcatgcgtcaggggcttggccttgcccggatgagggagagcacgcgttggtggtgtggggggggaggggtaagtggtgtagtagggtgtgggggaggggggagtagggcgtgggagggggagtaggatggggtgcgtgcttgcatgcgttgtcctgtagacaggcatgcgtgagtgtggaacttgggggaagctgctgtgctgaattgtgcaagcccattttatggcgataagggagattttgcactagccccatgcttcctaggtctccaggagcaggagcttgggcctggatttgcaaagcttgtgggctgcgcaaatgcactatgtaaaaatgcagcacactccttgagaaagtccactattaattcttagtaatgaatccacatcaaagtgcaagggtggaaacatgcacaatgatgcttagagcatccgagattgcttttcttttctttctttctttctttcttttcttttttttttgagacagtctcgctctgtctctggaatgcagtggcactatctgggctcactacaacctccatcttctgggtacctagattcagtaacagtgtatccacttagagacctcctctcttgcctttcctcttcccactatttgctgtgggttgggcctgctgaggtgcgcatgcctcaggggcttggccttgccttgggcacgggagagcacgtgttggagtgggggcagtaggacggggtggggggagtagggcgggggagggagtagggcgggggggcgtagggtggagggggggactagggcgggggggccggggagtaggatggggtgggtgtttgcatgtattgtgcaggtactcaggagtgcctcagcctcccgagtacctggaactacaggtgcgcaccagcacacctgggtaattattgtatttttagtagagacagggtttcaccatgtttgctgggctggtctggaactgctggccccaagtgatccacccacctcggcctcccaaagtgccgggattacaggcgtgagccaccgttcccagctgcagccaagatttctaaaattgcagggcatccttcctttgcctttggttgtgactgtggatagcgcagcttctgctatgtctctggctacagacccattacaaatgcgcacttaccttctgtgctgagctggtgctgtggacctgcagtgatttcccttctttcctgctgctgcatagccctcttttcctctactcctgcccttttctacagatatctttctgagctcttgtttaggaataaatacattttatttattgtcaaataatcacagccaggacagattgagtgctctaagattcttcctttaagaagtgttttgtagatacttcaggacttgttaatgtcctgaatatagagagtaggttttaaccatagaacctatcctccatcgtttgagtgactcattctatttttgcttgcacaatgacccttttcatcaaccttattttatataagaaattaaactagtttgtgggcccctacatgtactgtgggttccagtcaccccaacgactgatcctaatggatgagtgcacgcatcatacctcatgttcccagaggatgggtaagaaaacagctggaaaatatttgaccaattcacgttcaaagagatgggaagggatgacgatctaacagcctctttctgattttaactaagatgtctcctcgtcaggctggctcttcctggagctaaactgctggaatctgaaattttgctttgcttcctgttgctagctggctaatctcacttgatcactctccgtttgtgttagttttgtcatctgtaaaatgggaataacaatgataactatctcatggggttttcgaatagatggagatgattaaacatgctgcctcacatttcctgcttctgtcagtttgtatgtgtttatttacaagggtccttgaaaggagagagatgatggctattctctggcagtgggcaacaggggtaagatgttttattgtgaaaataatggttctataagtctttttgtacctatatgtacttcactcagtaaacctttgttggctgctgtgttgacagggccctgtggcaagaaatgtggggattgccacaatgtctgatcaatgcctgaccattgagatgtaggttctcatagtgtagtgggattgataaggaatcagagagactgatggggttcaggaggatatttattatttaggtgcaccggcccagtaagattaagatccaaagaactgagccctgaacaaagagttaagttactttttaagcatttcgtggggcagggggaagcatattgcagaagtgagaaacagagacagttattcaattaattgagacatgcattacatcatttcttagttttcaaggaaaaacatgttttatgacttgagtttatctgtctagtgaacttgcagctgcacagctagggaaacagggtcttcacaatgcctgggaaaggaggagagataaggctcactagccacagaaaaacaggcagttaatttttaaaggactccaactctttctctttctcaggggaattgggttttcttacatacgactgagtttctgcttacatattctttaatttcttttaattcctatttccattcccccctttggtgctttttataacaaaggtgttaatagaaagcaccactacttgccacctcttcgcggagctgagctgcttctactggcagtggctgatatttggttaatgccatcaactgtgcggtagtgtgtcgggttactattgcctctgtagttgactgaatactcctagtaagcaggggtaaaaggcaagggaggatgaggcagttgccaagaataagcaagaacctaccaatgagggttttgaatcctccaaaggctgagaaccatcctccaaacaaggaatccagggaccacccggatcaagtctgaactagaacatgggccaactcgcccattctagcagtgatttccataatagcttggccattatcatcgatttctaggcaacagttggttaaattaaattttctacatactcctccttctgaggctaagaggtaatccaaagctcatctattttgatgtatagcatttcttatttgtgttgcttgtattgccaataaacctagtgcccttggtgtttcattggttataatttcaaggactacctacaaccttatgatgcagttgagcatatagattggggtgcaatatccccatgaaccgtcttgcacccagatagctggcttataatatttaatgattctttcaggagaccattcattatcttttcagtctcctatgtccacatctttttgacatttgtgtctatttttgtgattatgcttcttctagttcttcttttattttcatcataaactggatatcctaagagttcctcttgctttagaggaattagaaagaaggatggcttgattgttcctaacacacatgcccctgtccatttagccggcagttgctgatgtacccatgctccacagatccattataggccagaggatgccttccaagcatttggagcctctagctgattccaagtgtggcttagagtagagaatcaagagaaagggtttggacctggtaagtaggagtcattctgggcatttctccgtagagttttgtttttagtctcatcataatgctgttgccctaggcaggttgtttctcctgctgcctctgtgaaagcctttccccatcgggtgatacagtactttttaattacggaggtttttaacaaccaaacactggctgaggctgttggttcactggcagggttaggcaaagtgaagttaccttgtggcattaattcctttgcctcccatggccactggtcacccatattagttcctccacatacatagcatgaggaaattcctaagctgccagttatgttttcagctagttgagcaaatatgtttttgggtgatgggggaagctcaggcactggctgatcaaaatgcttatagaatgacttatggacccagaattgggggattggacacatttgagtccttctagtctttttgacaatcagtagtggaactccaaggcctgcttcttgtctatcaactcataatagtgctgcctgccctgtagaccaaaaaggtagctctggctttaagatagtaaaatttaaagaattgcatgtccttgtcttacaatttagtttgactgacatactacttagcagagcagtccatcctgaatataagtgttggagctgtgttagcatagaccactgaatgttacggtccgggcatccgatttgtggttctccatacagatgtttagggctgttcctgctcagcctctcttgtgttaaaccattgcaggctgcttctgttttttttaagattatgaacatatgcggcatggcaggcatcaaagtacaaggaactacgccttttataggagggaggggcttctttggttcgagctataagctctccttctttttctccctctgatttaatatgtacctcaaaccagaattcataaggtaagagtttagggtcataacctacatgtagctgattatttcctgggtcacagaatgaataggtggtctggttgtatgtgcagattcctaacttggttcctgtacattcatagtaggtatggtacagtagagttttaactatggtgtttcttacccaggtagtgtgtacacagtatgggcatctttctagagatttctccttttttagtataggcagaaatggtaagaacattagtgtatataatagaaacatgcttacactacacatgggcatggcaaaccttcctctgggcatagacatttgcagcatttgcagtaataacataacataataaccagtattgacagaattatagctaggcttataaattgtatccacatttgcttatccggagatggtccttttagcttcggctgtgcatagactagtcagcttccgggctgtgactagagcagagcttgcaggattctcaagcttcacctgtgcgtagactgaccagcctccggtgtggtcagagcagggcagttgtccttcttaccggtagttgggttttgccataggactgttctggtggggcaatctgggtcttgttggctagtccactggtcgtcatggggagtcactgctgccgctggttttagccagctatggtgaatccaaggtgtgacacctgcaactttaacagcagtgggagtagacatgatcacaatatggagcccatcctataagggccccagggttgttggattccacctttttttttttttttttgagatggagtctcgctctgttgcccaggctggagtgcagtggcgcaatctcggctcactgcaagctgtgcctcccgggttcatgccattctcctgcctcagcctcccaagtagctgggactacaggtacccaccaccatgcctggctaattttttgttttcgtatttttagtagagacggggtttcaccgtgttagccaggatggtctcattctcctgatctcgtgatctcccccccgccggcctcccagagtgctgggattacaggtgtgagccaccaggcccagcctggattccacattttaacccagacagaatccccggtttatgtggatgcactgggtctgttagacttaaaggtatcctttcacttacccagccttgcacctcctgcattgccactcctaaagcctgcatctgtcttctaagggttagctctcctaactcctttaactaccctctaatttgattaatgattgggggtggccttccaaataatatttcatagggtgaatacccaatttgttctgtaagtgtacacctgacctggaggaggaccatgggcaagacctgatcccatcgtaagtgagtttcctggcaaaacatttttagtagctgtttgagtgtctggttcatccattccgccttccctgaactctgtggtcagtaggctgtgtgcagtttccatttgatctttaaaagctgagtcagctgtagtactacttctgccacaaatgcaggaccattgtctgatcctagggttaaaggcaatccaaaccttggtatgatgtcttttagtagcacctttgtcacctctcgtgccttttcagtcctggtggggaaggcctcaacccaccctgagaaggtgcaaagaaacactagcatataccggtaacctcctgctcaaggcaactcggtaaagtctacaagcaggttctcacaaggcacagctcccatttcctgaattcctgggggtcgaataggtccttgttttggcttattccagacacaggatagacattattcgcaaacagcatgggtgatggcagagagccgtggcacatagaagtgttgacctatcaaagtctctagtttccagtgtgtgttctttgatggatctgcttcacaaaccttgaggctattgtctctgggacgtctagtctcccatcagagaacagccaccatccacctttaatatatttccctgtttccagaacaaaacaagctttttcactcgaagagtaagggggtacctccagcaaagggggctctataaggagaggcattgctagagttctttcttcaggtgaagccttgctcattgctgcctgccgagcctcttggtctgcctttctgttgccctgcacctcatagcttttcctgatttggtgtcctttgcaatgaatgacagccaccttctccggagcccatacggcttccaataattgcaaaatttcctccttattttttatttcttttccttcagtagtcaaaagtcctctctctttgtgtattcccccatgggcacgcagggttgcaaaagcatattttgagtcagtacatatgtttactttcttccccttggccaataacagtgctctggttaatgctattaattcagccttcttagcggaagtcccagaaggtaaggcttgagcctcaaccactgagtgttgggtcactactgcatatcctgcatatctcaccccatctgttatgaaactgctaccatcagtgaagtatataacatctgggctctccaagggggaatctctgaggtcttcctggctcgagaacactttgtccaccatatttatgcaacagtggggaaggtcctgccaggagtgaggcaacccagcatccttccaatcgggttcctccacaggcagcagggtagctgggttcaaggtatttacattctctagtgttatctggggattttcacatagaagcccttgatactttagcattctagagttggacagccaaccatatcctctttgctccattaaggtgactacggcgtgtggcactgaactattaacttctgacctagggctagcttgttggcatcttctataaggattgcggtagctgccaatgccctgaggcagtggggccaacctaaagccaccaagtccagtcttttggataagtatgctaccggccgatgccaagagcccaagaactgagttaagactccaactgccattccttgacattcatccacatacaaaaaaagggcttttttacatttggcaaccctagtgccggggcctggatgagagcttcctttatatccttgaaggccttttcctgtttcttttgccataggaggggctctctttcctttccttttatagcctcatacaagggccttgctgtaagggagaagtttggaatacagattcggcagaatcctgccacgcctagaaattccctggccttgtaactggggtgggcagtgcacatacagcctccttgcgtgcacttaagcctgcgctggccttgggataccatgaatcctagatatccaacctcctgaaaacagacttttgccttgtccttggacactttataaccggcttcacacagcacgtgaagaagcctctctgttccttggagtcattcctccctcgtgggggcggcaaataggaaatcatcaatgtgttgtaatagcacataattgtcactaggtggcgcaaaagcctcaagatctgtagccaaggcctcctcaaaaatggtagaattcttaaacccttacggcagccttgtccaggtatattgcgattgccccctctgactttggggagcaagcttcaaacaaaagaaggcatcctttaagtccagacatgtgatccaagtggcatcagcaggaatctgtcccaacattgtgtatgggttgggtactgttgcatggatagcgacagtggccttgtttaccacccggagatcctgcactggcctgtattccccatttgatttgtgcatgggtaacagaggagtattccatgaggacttgcattttactataatcccatgtgtataaagccgattcagatgcttttgttattccatcaattgcctccctgggtactgggtattgacggactcataccggggcagcatgagggttaagctctgctaccactgggggtctgtttgcagcaagtccagggtattatcctcggcccatacacctggtaccttgaaaagcatcccccatatattgtgtaggtcggttctggtgaccttctggcacacggttcacacagccaccattcctcagcccttgggacagttggagttcataccattgccttggactttccaaactccagtgtcatattccctttaggcgtaaagaaaatttctgcctgcagtttctggagtaagtctctccccagcaagggcactggacaatttggcatatacggaaactcatgctgcacttcttgtcc
